US008865882B2

(12) United States Patent
Chaganti et al.

(10) Patent No.: US 8,865,882 B2
(45) Date of Patent: Oct. 21, 2014

(54) METHODS FOR DETECTING HUMAN PAPILLOMA VIRUS-ASSOCIATED CANCERS

(75) Inventors: Raju S. K. Chaganti, Hillsdale, NJ (US); Jane Houldsworth, Franklin Lakes, NJ (US)

(73) Assignee: Cancer Genetics, Inc., Rutherford, NJ (US)

( * ) Notice: Subject to any disclaimer, the term of this patent is extended or adjusted under 35 U.S.C. 154(b) by 0 days.

(21) Appl. No.: 13/227,027

(22) Filed: Sep. 7, 2011

(65) Prior Publication Data

US 2012/0202200 A1     Aug. 9, 2012

Related U.S. Application Data

(60) Provisional application No. 61/380,894, filed on Sep. 8, 2010.

(51) Int. Cl.
*C07H 21/04*     (2006.01)
*C12Q 1/68*      (2006.01)
*C12Q 1/70*      (2006.01)

(52) U.S. Cl.
CPC .......... *C12Q 1/708* (2013.01); *C12Q 2600/112* (2013.01); *C12Q 1/6886* (2013.01)
USPC ...................................................... 536/24.3

(58) Field of Classification Search
None
See application file for complete search history.

(56) References Cited

U.S. PATENT DOCUMENTS

| | | | |
|---|---|---|---|
| 5,919,624 | A | 7/1999 | Ried et al. |
| 7,517,645 | B2 | 4/2009 | Sokolova et al. |
| 8,043,805 | B2 | 10/2011 | Sokolova et al. |
| 8,409,808 | B2 | 4/2013 | Ried et al. |
| 8,603,746 | B2 | 12/2013 | Endress et al. |
| 8,603,747 | B2 | 12/2013 | Endress et al. |
| 2009/0035763 | A1 | 2/2009 | Reid et al. |
| 2012/0164626 | A1 | 6/2012 | Sokolova et al. |

FOREIGN PATENT DOCUMENTS

| | | | |
|---|---|---|---|
| WO | WO 2005/001137 | A2 | 1/2005 |
| WO | WO 2005001137 | A2 * | 1/2005 |
| WO | WO 2010/011683 | A2 | 1/2010 |

OTHER PUBLICATIONS de Leeuw et al., Human Molecular Genetics, 2004, vol. 13, pp. 1827-1837.*
Mertens et al., Cancer Research, 1997, vol. 57, pp. 2765-2780.*
Caraway, N., et al., "Gain of the 3q26 region in cervicovaginal liquid-based pap preparations is associated with squamous intraepithelial lesions and squamous cell carcinoma," *Gynecologic Oncology*, 2008, vol. 110(1), pp. 37-42.
Heselmeyer-Haddad, K., et al., "Detection of Genomic Amplification of the Human Telomerase Gene (*TERC*) in Cytologic Specimens as a Genetic Test for the Diagnosis of Cervical Dysplasia," *American Journal of Pathology*, 2003, vol. 163(4), pp. 1405-1416.
Hopman, A., et al., "Genomic integration of oncogenic HPV and gain of the human telomerase gene *TERC* at 3q26 are strongly associated events in the progression of uterine cervical dysplasia to invasive cancer," *Journal of Pathology*, 2006, vol. 210(4), pp. 412-419.
Seppo, A., et al., "Gain of 3q26: A genetic marker in low-grade squamous intraepithelial lesions (LSIL) of the uterine cervix," *Gynecologic Oncology*, 2009, vol. 114(1), pp. 80-83.
Sokolova, I., et al., "Chromosomal Biomarkers for Detection of Human Papillomavirus Associated Genomic Instability in Epithelial Cells of Cervical Cytology Specimens," *Journal of Molecular Diagnostics*, 2007, vol. 9(5), pp. 604-611.
Tu, Z., et al., "Genomic amplification of the human telomerase RNA gene for differential diagnosis of cervical disorders," *Cancer Genetics and Cytogenetics*, 2009, vol. 191(1), pp. 10-16.
Voss, J., et al., "Assessment of Fluorescence in Situ Hybridization and Hybrid Capture 2 Analyses of Cervical Cytology Specimens Diagnosed as Low Grade Squamous Intraepithelial Lesion for the Detection of High Grade Cervical Intraepithelial Neoplasia," *Analytical and Quantitative Cytology and Histology* ®, 2010, vol. 32(3), pp. 121-130.
Mertens, F., et al., "Chromosomal Imbalance Maps of Malignant Solid Tumors: A Cytogenetic Survey of 3185 Neoplasms," *Cancer Research*, 1997, vol. 57, pp. 2765-2780.
Myllykangas, S., et al., "Specificity, selection and significance of gene amplifications in cancer," *Seminars in Cancer Biology*, 2007, vol. 17(1), pp. 42-55.
Policht, F., et al., "Analysis of genetic copy number changes in cervical disease progression," *BMC Cancer*, 2010, vol. 10(1), p. 432 (twelve pages).
Arias-Pulido, H., et al., "Mapping common deleted regions on 5p15 in cervical carcinoma and their occurrence in precancerous lesions," *Molecular Cancer*, Oct. 1, 2002, pp. 1-7, vol. 1(3), Open Access.
Atkin, N., "Cytogenetics of Carcinoma of the Cervix Uteri: A Review," *Cancer Genet Cytogenet*, 1997, pp. 33-39, vol. 95, Elsevier.
Hesselmeyer, K., et al., "Advanced-Stage Cervical Carcinomas Are Defined by a Recurrent Pattern of Chromosomal Aberrations Revealing High Genetic Instability and a Consistent Gain of Chromosome Arm 3q," *Genes, Chromosomes & Cancer*, 1997, pp. 233-240, vol. 19, Wiley-Liss, Inc.
Huang, F., et al., "Genetic abnormalities and HPV status in cervical and vulvar squamous cell carcinomas," *Cancer Genetics and Cytogenetics*, 2005, pp. 42-48, vol. 157, Elsevier.
Huang, K., et al., "Chromosomal Gain of 3q and Loss of 11q Often Associated with Nodal Metastasis in Early Stage Cervical Squamous Cell Carcinoma," *J. Formos Med. Assoc.*, 2007, pp. 894-902, vol. 106(11), Elsevier & Formosan Medical Association.

(Continued)

*Primary Examiner* — Michele K Joike
*Assistant Examiner* — Mindy G Brown
(74) *Attorney, Agent, or Firm* — Alston & Bird LLP

(57) ABSTRACT

The present invention provides probes and methods of use thereof in the diagnosis and/or prognosis of certain types of cancers, particularly human papillomavirus (HPV)-associated cancers. The probes are designed for hybridization with genomic material in a manner indicative of one or more aberrations in the genetic material present in the test sample. The identified aberrations are biomarkers of HPV-associated cancer. The methods of the invention comprise contacting a sample to one or more probes, allowing any genetic material in the sample to hybridize to the genomic regions provided in the probes, analyzing the hybridizations, and analyzing the hybridizations to identify detected aberrations as biomarkers indicative of HPV-associated cancer progression.

11 Claims, 2 Drawing Sheets

(56) References Cited

OTHER PUBLICATIONS

Katz, R., et al., "Automated detection of genetic abnormalities combined with cytology in sputum is a sensitive predictor of lung cancer," *Mod. Pathol.*, 2008, pp. 950-960, vol. 21(8), USCAP, Inc.

Lyng, H., et al., "Intratumor Chromosomal Heterogeneity in Advanced Carcinomas of the Uterine Cervix," *Int. J. Cancer*, 2004, pp. 358-366, vol. 111, Wiley-Liss, Inc.

Macville, M., et al., "Comprehensive and Definitive Molecular Cytogenetic Characterization of HeLa Cells by Spectral Karyotyping," *Cancer Research*, Jan. 1, 1999, pp. 141-150, vol. 59, American Association for Cancer Research.

Rao, P., et al., "Chromosomal amplifications, 3q gain and deletions of 2q33-q37 are the frequent genetic changes in cervical carcinoma," *BMC Cancer*, 2004, pp. 1-9, vol. 4(5), Open Access.

Olaharski, A., et al., "Tetraploidy and chromosomal instability are early events during cervical carcinogenesis," *Carcinogenesis*, 2006, pp. 337-343, vol. 27(2), Oxford University Press.

Sokolova, I., et al., The Development of a Multitarget, Culticolor Fluorescence in Situ Hybridization Assay for the Detection of Urothelial Carcinoma in Urine, *Journal of Molecular Diagnostics*, Aug. 2000, pp. 116-123, vol. 2(3), American Society for Investigative Pathology and the Association for Molecular Pathology.

Qin, Y., et al., "Comparative genomic hybridization analysis of genetic aberrations associated with development of esophageal squamous cell carcinoma in Henan, China," *World J Gastroenteral*, 2008, vol. 14(12), pp. 1828-1835.

* cited by examiner

METHODS FOR DETECTING HUMAN PAPILLOMA VIRUS-ASSOCIATED CANCERS

CROSS-REFERENCE TO RELATED APPLICATION

This application claims the benefit of U.S. Provisional Patent Application No. 61/380,894, filed Sep. 8, 2010, which is hereby incorporated herein in its entirety by reference.

FIELD OF THE INVENTION

The present invention provides for the detection of precancers and cancers, particularly those types associated with human papillomavirus (HPV). The diagnostic tool can utilize a probe set for detecting biomarkers in a sample indicative of HPV-associated precancer and cancer. The invention thus also provides methods for the detection of HPV-associated precancer and cancer, preferentially with minimal invasiveness.

BACKGROUND OF THE INVENTION

Papillomaviruses are ubiquitous, small, non-enveloped viruses with a double-stranded DNA genome of about 8 kbp. Papillomaviruses infect squamous basal epithelial cells through wounds or abrasions and encode about 10 proteins involved in viral DNA replication and structure, and in cell transformation (Burd E M., *Clin. Microbiol. Rev.* (2003), 16 (1):1-17; and Psyrri A, DiMaio D., *Nat. Clin. Pract. Oncol.* (2008), 5 (1):24-31). Duplication of the viral genome absolutely requires host-cell DNA replication components which would otherwise be relatively inactive at this stage of host-cell differentiation but are activated by virally encoded E6 and E7 proteins. The E6 and E7 proteins interact with various host-cell proteins, of which TP53 and RB1, respectively, have been determined to be the functional targets effecting reactivation of cell cycle progression and viral DNA replication. Overall, the process is not cytolytic, with viral DNA evident throughout the thickness of the epithelium and intact virions only apparent in the upper layers.

Infection with HPV is associated with an array of clinical conditions ranging from benign hyperplasias, such as warts and papillomas, to cancer, such as cervical, esophageal, oropharyngeal, vulval, vaginal, penile, and anal types. To date, more than 200 different HPV types have been isolated and are generally categorized into two groups (i.e., low-risk and high-risk) according to the frequency with which they are found in human cancer. Only a small fraction of those individuals infected with high-risk HPV actually develop cancer, which often occurs many years after the initial infection. HPV types 6 and 11 are low-risk types and are generally associated with over 90% of benign lesions. HPV-16 is the most common HPV type found associated with a malignant phenotype and together with HPV-18 exemplifies high-risk HPV types. About 30 HPV types have been identified that are spread through sexual contact and infect primarily the cervix, vagina, penis, and anus (anogenital regions). Of these types, there are four that are mostly found in malignant cells of cervical cancer: HPV-16, HPV31, and HPV-45. Together, HPV-16 and HPV-18 are responsible for 70% of cervical cancer. Worldwide, HPV has been implicated as an etiologic agent in 99.7% of cervical squamous cancer, with evidence that it also plays a role in adenocarcinomas of the cervix.

Many studies over the years, both epidemiologic and molecular in nature, have revealed the causative role of high-risk HPV types in human cancer, mostly with cervical cancer serving as the model system. From a public health viewpoint, once a causative role has been established, the diseases are largely preventable with the use of prophylactic anti-HPV vaccines. For cervical cancer, two such vaccines are available: GARDASIL®, which is directed against HPV types 6, 11, 16, and 18, and CERVARIX®, which is directed against HPV types 16 and 18 (Bosch F X, Castellsague X, de Sanjose S., *Br. J. Cancer* (2008), 98 (1):15-21). However, it must be remembered that HPV infection alone is not sufficient for carcinogenesis. Indeed, additional oncogenic events within the host cell must occur in order for malignant transformation to result.

It is estimated that HPV is associated with 500,000 new cases of cervical cancer and 250,000 cervical cancer deaths worldwide each year. Within the US, it was estimated for 2008 that 11,070 new cases would be diagnosed, and about 3,870 women would die of their disease (Jemal A, Siegel R, Ward E, et al., *CA Cancer J. Clin.* (2008), 58 (2):71-96). The disease usually presents in several premalignant stages ranging from mild dysplasia (cervical intraepithelial neoplasia grade 1 [CIN1]) to more severe degrees of neoplasia and microinvasive lesions (CIN2 or CIN3), to invasive cancer. Classification of the disease according to this CIN System forms the basis of diagnosis and treatment approaches including therapeutic options and secondary preventive measures. Importantly, CIN1 lesions can regress spontaneously with the risk of progression to severe dysplasia being 1% per year. Risk of progression of moderate dysplastic lesions is 16% within 2 years and 25% within 5 years.

Historically, the primary screening program for this disease has relied upon the cytologic appearance of abnormal cells in the transformation zone of the cervix (Pap test). The results of Pap tests are currently being reported according to the Bethesda classification system (revised in 2001), as outlined in Table 1. The comparable CIN histologic classification is also given.

TABLE 1

Bethesda Classification System for Cervical Squamous Cell Dysplasia

| Bethesda System | CIN System | Interpretation |
| --- | --- | --- |
| NIL: Negative for intraepithelial lesions or malignancy | Normal | No abnormal cells |
| ASC-US: Atypical squamous cells of undetermined significance | | Squamous cells with abnormalities greater than those attributed to reactive changes but do not meet the criteria for a squamous intraepithelial lesion |
| ASC-H: Atypical squamous cells, cannot exclude HSIL | | |
| LSIL: Low-grade squamous intraepithelial lesions | CIN 1 | Mildly abnormal squamous cells |

TABLE 1-continued

Bethesda Classification System for Cervical Squamous Cell Dysplasia

| Bethesda System | CIN System | Interpretation |
| --- | --- | --- |
| HSIL: High grade intraepithelial lesions with features suspicious for invasion if suspected | CIN 2/3 | Moderately or severely abnormal squamous cells |
| Carcinoma | Invasive squamous cell carcinoma, invasive glandular cell adenocarcinoma | The possibility of cancer is high enough to warrant immediate evaluation but does not mean that the patient has cancer. |

In the United States, about 55 million Pap smears are performed each year, and of these approximately 5% (2,750,000 smears per year) are diagnosed as containing atypical squamous cells of undetermined significance (ASC-US). It is known that about 39% of women with high grade disease (CIN2/CIN3 or frank cancer) will actually present as ASC-US. Thus, considering the 2,750,000 smears diagnosed as ASC-US each year, just under 10% have underlying CIN3 or cancer. The ASC-US and LSIL Triage Study (ALTS) was established as a NCI-sponsored multicenter randomized trial that would evaluate management options for this group of women including immediate colposcopy (costly), HPV DNA testing for high risk HPV types (less costly, using the Hybrid Capture 2 sold by Qiagen), and repeat cytology examinations (two follow-up visits) ("Human papillomavirus testing for triage of women with cytologic evidence of low-grade squamous intraepithelial lesions: baseline data from a randomized trial. The Atypical Squamous Cells of Undetermined Significance/Low-Grade Squamous Intraepithelial Lesions Triage Study (ALTS) Group. *J. Natl. Cancer Inst.* (2000), 92 (5): 397-402; and Solomon D, Schiffman M, Tarone R., *J. Natl. Cancer Inst.* (2001), 93 (4):293-9). While the ALTS trial indicated that two repeat cytology examinations were as sensitive as HPV DNA testing for detecting CIN3 and cancer (CIN3+) in triaging women diagnosed with ASC-US for follow-up colposcopy, if only one repeat cytologic examination was performed due to cost, then this management option lost sensitivity. Thus, HPV DNA testing is considered an economically viable triaging strategy that should only be used in conjunction with the Pap test. In the study, it reduced the number of patients undergoing colposcopy by 44%. Patients over 21 with ASC-US who are positive for high-risk HPV DNA then, are referred for colposcopy and those who are negative are conservatively managed with repeat Pap smears at 6 and 12 months. In the ALTS trial it was found that of those referred to colposcopy based on a positive HPV test, about 28% actually had CIN2/3+, 23% had CIN1, and the remaining were normal upon biopsy. Clinical management then of this large group with equivocal or mildly abnormal tests every year where follow-up colposcopy is indicated upon a positive HPV test is daunting, and additional triage such as the introduction of the testing of new biomarkers would be desirable.

In patients with LSIL, it was found that 83% had positive HPV DNA tests with little predictive power of regression versus progression. According to the current NCCN Clinical Practice Guidelines in Oncology for Cervical Cancer Screening, women over 21 with ASC, LSIL, or HSIL are currently recommended to undergo colposcopic examination and subsequent treatment according to the biopsy histology. At this stage of patient management, the success of screening heavily depends on the accuracy of the colposcopically-directed biopsies of the approximately 2,000,000 women each year in the US who undergo colposcopy. Subsequent NCI-funded studies are directed both at improving biopsy procedures and the identification of biomarkers to assist in the diagnostic classification of patients who require additional treatment. Patients with normal or CIN1 results may be followed with repeat Pap tests or HPV DNA testing. For those with CIN2/3, further treatment is indicated such as loop electrosurgical excision procedure (LEEP), cryotherapy, cold-knife conization (CKC), or laser ablation. In this case, CIN2 patients are treated as a safety net since biomarkers to identify those lesions that will regress versus progress have as yet to be defined and fully evaluated. Total hysterectomy may be considered for women with CIN3. Diagnosis with invasive carcinoma requires total hysterectomy or external beam high-energy radiotherapy and implants with $^{192}$Ir, depending on the stage. Selected patients also benefit from chemotherapy.

Thus, despite the remarkable successes of cervical cancer screening programs in industrialized countries, improvement in the current screening procedures are warranted to identify women (young and old) with either high-grade disease or low-grade disease with the likelihood of progression, who will require follow-up and treatment for the disease, from those who will be submitted to unnecessary and costly medical procedures. This need arises not only from limitations within current screening tests such as inadequate sampling errors and false-positive and -negative rates, but also due to the inherent nature of the disease, in that as yet few, if any, robust biomarkers to risk-stratify low grade lesions into those likely to regress versus those likely to progress have been identified. Overall then, additional biomarkers of the disease are required, for which assays can be incorporated into screening programs to improve the sensitivity of early cervical cancer detection. From a global health issue, reduction in the costs of any such screening program clearly would positively impact screening coverage of such programs in low resource countries where cervical cancer is prevalent and death rates from the disease are higher.

Another cancer causally associated with HPV is anal cancer, though due to more limited data the exact percent caused by HPV and the most involved types of HPV have yet to be confirmed (Daling J R, Madeleine M M, Johnson L G, et al., *Cancer* (2004), 101 (2):270-80). In the U.S. in 2008, 5,070 new cases are estimated to be diagnosed with 680 deaths. So while it is relatively uncommon in the general population, it occurs at a higher rate amongst at-risk populations such as those engaged in receptive anal intercourse. In men who have sex with men (MSM), approximately 40 per 100,000 are affected, with an even higher rate evident in HIV-infected MSM (Chin-Hong P V, Palefsky J M., *Clin. Infect. Dis.* (2002), 35 (9):1127-34). Presumably the latter risk factor is due to a compromised immune response and enhanced failure to clear high risk HPV infections. One significant difference between anal HPV in MSM and cervical HPV infection in women is the age at which HPV is prevalent and at which cellular abnormalities are detected (Chin-Hong P V, Vittinghoff E, Cranston R D, et al., *J. Natl. Cancer Inst.* (2005), 97

(12):896-905; and Franceschi S, Herrero R, Clifford G M, et al., *Int. J Cancer* (2006), 119 (11):2677-84). Cervical HPV infection is highly prevalent in the few years following initiation of sexual contact, but declines as women enter their 30's and 40's. In contrast, HPV prevalence and cytologic premalignant lesions of the anus in MSM appear to be higher in all adult age groups, an important consideration in the development of a screening program for anal cancer prevention in populations at risk.

As for cervical cancer, classification of premalignant lesions into anal intraepithelial neoplasia grades (AIN1-3) depends on the extent of dysplasia and evidence for neoplasia. The sensitivity for anal cytology for the detection of premalignant and malignant lesions is only around 70% in a high risk population, comparable to that for cervical cancer (Palefsky J M, Holly E A, Hogeboom C J, Berry J M, Jay N, Darragh T M., *J. Acquir. Immune Defic. Syndr. Hum. Retrovirol.* (1997), 14 (5):415-22). However, unlike cervical cancer, carcinogenic HPV testing as a screening tool may not be effective for several reasons: high prevalence of high risk HPV in at risk populations, more limited number of HPV types involved, and cross-reactivity of HPV testing with noncarcinogenic HPV types. Thus, for anal cancer in high risk populations, an effective screening program has yet to be defined to guide clinical practice. Currently, clinicians perform anoscopy or high-resolution anoscopy (HRA) as additional workup, which in comparison to colposcopy may only be about 70% sensitive for the detection of premalignant lesions. While there is no consensus that a screening program is warranted for this disease, the introduction of an assay that reduces the number of MSM who undergo the relatively invasive and costly anoscopy procedure will potentially be cost-effective and greatly increase the efficiency with which those whom require immediate treatment are identified.

Over the past 15 years, despite a reduction in the number of people smoking cigarettes, the incidence of head and neck squamous cell cancer (HNSCC) has not declined. The growing subset of HNSCCs associated with HPV are thought to be largely responsible for this. The HPV-associated HNSCCs are commonly oropharyngeal and to a lesser extent pharyngeal in origin. Oropharyngeal cancers form in tissues of the oropharynx, which is the middle part of the throat and includes the soft palate, the base of the tongue, and the tonsils. These cancers seen in a younger non-smoking population are biologically and clinically distinct from carcinogen-induced HNSCC, often associated with sexual behavior, and overall have a better prognosis (Allen C T, Lewis J S, El-Mofty S K, Haughey B H, Nussenbaum B., Laryngoscope (2010), 120 (9):1756-72, "Human Papillomaviruses and Cancer: Questions and Answers," National Cancer Institute Fact Sheet, Pub. No. F703, revised Feb. 14, 2008). Early detection screening programs amongst at-risk populations are not in place, and often diagnosis is delayed.

Thus, there is a need for the early detection of HPV-associated precancers and cancers in patients so that appropriate treatment programs can be initiated early in the disease progression. It is an object of the present invention to provide methods for the early detection of HPV-associated precancers and cancers.

BRIEF SUMMARY OF THE INVENTION

The present invention provides methods for identifying an individual with one or more human chromosomal abnormalities diagnostic or indicative of one or more types of HPV-associated precancer and cancer. The methods of the present invention are generally applicable to any one or more types of HPV-associated precancers and cancers including, but not limited to, precancers and cancers of the cervix, anus, vulva, vagina, penis, oropharynx, and pharynx. The methods involve obtaining a sample from an individual, wherein the sample comprises genetic material including, for example, chromosomes. The sample will typically comprise cells from a body tissue or fluid thereof that is expected to comprise the one or more chromosomal abnormalities diagnostic or indicative of one or more types of HPV-associated cancer. Such tissues include, for example, cervical, anal, vulval, vaginal, penile, orophayngeal, and pharyngeal tissues. The methods further involve providing a probe set comprising at least one probe which is individually capable of hybridizing selectively to a specific marker or correlate marker thereof that is associated with a human chromosomal abnormality diagnostic or indicative of one or more types of HPV-associated cancer. The methods further involve using the probe set to determine if the sample comprises at least one of said chromosomal abnormalities. In one embodiment of the invention, fluorescence in situ hybridization (FISH) is used to detect the one or more chromosomal abnormalities.

The present invention further provides methods of identifying in a sample one or more chromosomal abnormalities diagnostic or indicative of one or more types of HPV-associated precancer or cancer. The method comprises providing a probe set comprising at least one probe which is individually capable of hybridizing selectively to a specific marker or correlate marker thereof that is associated with a human chromosomal abnormality diagnostic or indicative of one or more types of HPV-associated cancers. The methods further involve using the probe set to determine if the sample comprises at least one of said chromosomal abnormalities.

Also provided are probe sets for detecting biomarkers in a sample indicative of HPV-associated cancer. The probe sets comprise at least one but preferably two, three or more probes. The probes are individually capable of hybridizing selectively to a specific marker or correlate marker thereof, wherein in said specific marker is associated with a human chromosomal abnormality diagnostic or indicative of one or more types of HPV-associated cancer. Preferably, the one or more probes are selected from the group consisting of a probe that hybridizes to 3q, a probe that hybridizes to 5p, a probe that hybridizes to 20q, and a probe that hybridizes to cen7.

BRIEF DESCRIPTION OF THE FIGURES

Figure 1:
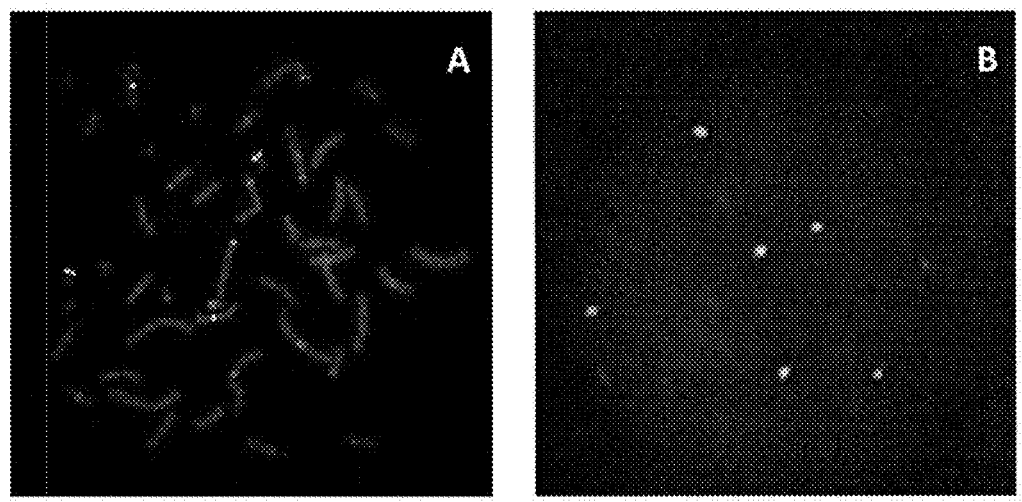
Figure 2:
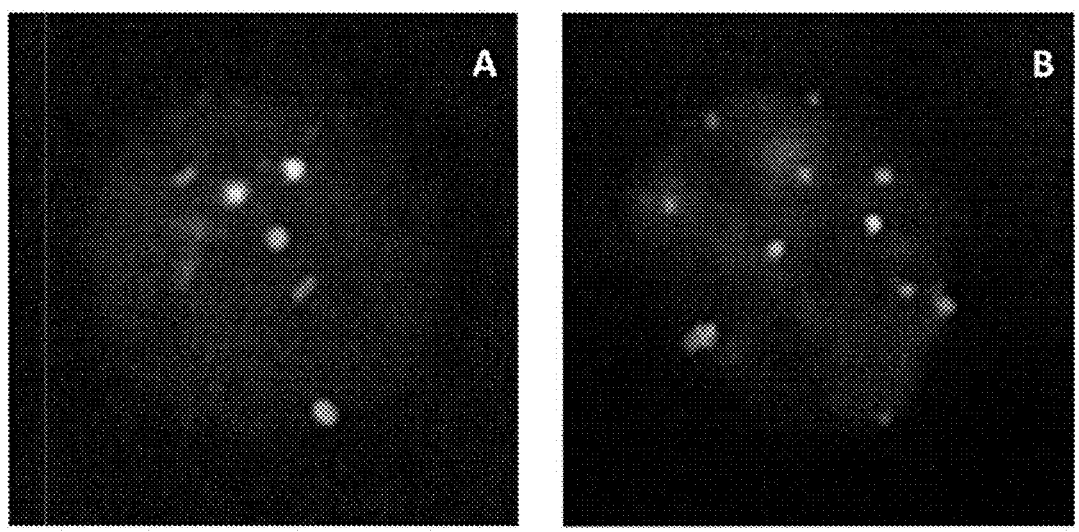

Having thus described the present invention in general terms, reference will now be made to the accompanying drawings, which are not necessarily drawn to scale, and wherein:

FIG. 1 provides representative FISH images of normal lymphocyte metaphase (A) and interphase nuclei (B) showing two each of the 3q (red, R), 5p (green, G), 20q (gold, Go), and cen7 (blue, B) signals (2R, 2G, 2Go, 2B) at the correct chromosomal sites; and FIG. 2 provides representative FISH images of interphase nuclei of liquid-based cervical cytology specimens: normal (A), with a normal hybridization pattern (2R, 2G, 2Go, 2B), and CIN3 specimens (B) with an abnormal pattern (3R, 3G, 3Go, 2B) interpreted as 3q, 5p, and 20q gain.

DETAILED DESCRIPTION OF THE INVENTION

The invention now will be described more fully hereinafter through reference to various embodiments. These embodiments are provided so that this disclosure will be thorough and complete, and will fully convey the scope of the invention to those skilled in the art. Indeed, the invention may be embodied in many different forms and should not be construed as limited to the embodiments set forth herein; rather, these embodiments are provided so that this disclosure will satisfy applicable legal requirements. As used in the specification, and in the appended claims, the singular forms "a", "an", "the", include plural referents unless the context clearly dictates otherwise.

Various technical and scientific terms are used in the present disclosure, and the meaning of said terms is understood to be as expressly defined herein or as otherwise ascertainable from the context of the present disclosure. To the extend such terms are not expressly or inherently defined herein, the meaning of such terms is understood to be the same as commonly understood by one of ordinary skill in the art to which this invention belongs.

As used herein, the term "genomic region" is intended to mean a portion of nucleic acid polymer that is contained within the human genome complement. The term also relates to a specific length of DNA contained within bacterial artificial chromosomes (BACs), wherein the DNA has a sequence that corresponds to a portion of the human genome. The term also can be used in relation to specific oligonucleotides that have sequences that correspond to a portion of the human genome. The location of the nucleic acid polymer within the genome can be defined with respect to either the chromosomal band in the human genome or one or more specific nucleotide positions in the human genome.

As used herein, the terms "cancer" and "cancerous" are intended to mean the physiological condition in mammals that is typically characterized by unregulated cell growth. Examples of cancer include any cancer associated with HPV, including, for example, cancers of the cervix, anus, vulva, vagina, penis, oropharynx, and pharynx.

As used herein, the terms "precancer" and "precancerous" are intended to mean the physiological condition in mammals that is typically characterized by unregulated cell growth that will progress to cancer. Examples of precancer include any precancer associated with HPV including, for example, precancers of the cervix, anus, vulva, vagina, penis, oropharynx, and pharynx.

As used herein, the terms "biopsy" and "biopsy specimen" are intended to mean a biological sample of tissue, cells, or liquid taken from the human body.

As used herein, the term "genetic material" is intended to mean materials comprising or formed predominately of nucleic acids. The term specifically is intended to encompass, deoxyribonucleic acids (DNA) or fragments thereof and ribonucleic acids (RNA) or fragments thereof. The term also can be used in reference to genes, chromosomes, and/or oligonucleotides and can encompass any portion of the nuclear genome and/or the mitochondrial genome of the human body.

As used herein, "gain" of a chromosomal segment (e.g., "gain of 3q" or "3q gain") refers to multiplication (amplification) of all or any part thereof of the chromosome segment resulting in increased copy number of the segment. In one embodiment of the invention, "gain of 3q" is multiplication (amplification) within 3q26.

As used herein, "loss" of a chromosomal segment (e.g., "loss of 3q" or "3q loss") refers to a deletion of all or any part thereof of the chromosome segment resulting in decreased copy number of the segment.

As used herein, "tetraploidy" refers to a duplication of the chromosomal complement as occurs during the normal process of cell division.

As used herein, the term "label" is intended to mean any substance that can be attached to a probe so that when the probe binds to a corresponding site a signal is emitted or the labeled probe can be detected by a human observer or an analytical instrument. Labels envisioned by the present invention can include any labels that emit a signal and allow for identification of a component in a sample. Non-limiting examples of labels encompassed by the present invention include fluorescent moieties, radioactive moieties, chromogenic moieties, and enzymatic moieties.

As used herein, the term "probe" is intended to mean any molecular structure or substructure that hybridizes or otherwise binds to a genomic region.

As used herein, a "marker", "cellular marker", "biomarker", molecular marker", or "disease marker" is any molecular structure or substructure that is correlated with a disease state or pathogen. Broadly defined, a marker is a biological indicator that may be deliberately used by an observer or instrument to reveal, detect, or measure the presence or frequency and/or amount of a specific condition, event or substance. For example, molecular markers are specific molecules, such as proteins or protein fragments, whose presence within a cell or tissue indicates a particular disease state.

As used herein, "cytogenetic abnormality" when used in singular or plural, shall mean an alteration in the human genome that can be detected by examination of the chromosomes. A "cytogenetic abnormality" is also referred to herein as a "chromosomal abnormality".

As used herein, "cytogenetic assay" shall mean a laboratory assay that examines chromosomes.

As used herein, "BAC" (Bacterial artificial chromosome) is a laboratory creation involving an artificially constructed chromosome in which medium-sized segments of DNA (100,000 to 300,000 bases in length) that come from another species are cloned into bacteria. Once the foreign DNA has been cloned into the bacteria's chromosome, many copies of it can be made (amplified) and sequenced. Bacterial artificial chromosome is abbreviated BAC.

Many studies over the years, both epidemiologic and molecular in nature, have revealed the causative role of high-risk human papillomavirus (HPV) types in human cancer, particularly those of the anogenital region, including, but not limited to, cervical and anal cancers. The etiologic course of such HPV-associated cancers has been suggested to involve infection by HPV, persistence of the infection, progression to an immediate precursor of cancer, and finally invasion (the latter two steps requiring additional host oncogenic events). Successful screening programs based on the appearance of abnormal cells in cytology specimens, and more recently HPV-type, have been implemented for cervical cancer; however, there is a great need to identify additional biomarkers to increase the sensitivity with which precancer and cancer are detected in cytology specimens. The present invention achieves this end and can provide additional triage of the approximately 2,000,000 women each year in the U.S. who undergo colposcopy for follow-up of abnormal cytology, reducing the performance of costly and often unnecessary procedures, and ultimately increasing the cost-effectiveness of the overall screening program leading to increased global population coverage by such programs.

The present invention is not limited to methods for identifying an individual that has HPV-associated precancer and cancer of the cervix and anus. The methods of the present invention are generally applicable to any one or more types of HPV-associated precancers and cancers including, but not limited to, precancers and cancers of the cervix, anus, vulva, vagina, penis, oropharynx, and pharynx.

Gain of 3q and to a lesser extent gain of 5p and 20q, are genomic abnormalities commonly detected in HPV-associated cancers, and as such represent potential biomarkers of HPV-associated cancer progression. The present invention is, in certain embodiments, a fluorescence in situ hybridization (FISH)-based HPV-associated cancer detection test (FHACT) to detect genomic abnormalities in cervical, anal, vulval, vaginal, penile, oropharyngeal, and pharyngeal specimens. In further embodiments, the invention can provide for use of the test in HPV-associated cancer screening programs.

In specific embodiments, the invention provides a robust, sensitive, and specific FISH-based test that, together with standard cytology and HPV-typing, can provide for accurate detection of precancer and cancer in cytology specimens. Such test can significantly impact standard-of-care recommendations in HPV-associated cancer screening programs and can identify patients requiring additional follow-up and treatment.

The present invention provides for the assessment of genomic alterations in the diagnosis and prognosis of precancer, particularly HPV-associated cancer. In particular, the invention provides the ability to use hybridization technology, such as fluorescence in situ hybridization (FISH), as a clinical tool for the diagnosis and prognosis of HPV-associated cancer.

In one aspect, the invention can provide a probe set for detecting biomarkers in a sample that are indicative of HPV-associated cancer. In certain embodiments, the probe set can comprise a plurality of labeled, distinct genomic regions, such as DNA fragments (including bacterial artificial chromosomes [BACs]). Preferably, each of the distinct genomic regions is individually capable of hybridizing to material present in the sample. Moreover, the genomic regions in the probe set can be regions wherein an alteration therein is correlated to one or more types of HPV-associated cancer (i.e., are biomarkers indicative of HPV-associated cancer progression).

In another aspect, the invention also can provide methods of detecting biomarkers in a sample indicative of HPV-associated cancer progression. Such methods can be useful to identify precancer cells, formations, or the like, as well as early and/or late stage cancer. In certain embodiments, a method according to the invention can comprise the following steps: (a) providing a probe set as described herein; (b) providing the sample with genetic material therein; (c) hybridizing the genetic material in the sample with the probe set; (d) analyzing the hybridization pattern of the genetic material in the sample to the probe set to detect patterns indicating the presence of alterations in the genetic material from the sample; and (e) identifying any detected alterations as biomarkers indicative of HPV-associated cancer progression. In specific embodiments, the method of the invention particularly comprises fluorescence in situ hybridization (FISH).

In order to improve the clinical utility of cervical/anal cytology and HPV testing in cancer prevention screening programs, there is great interest to identify additional biomarkers of progression from HPV-infected tissue to dysplasia, and then to neoplasia. In the former case, it is the altered expression of the viral oncogenes E6 and E7 that deregulate host cell cycle control, effectively leading to unregulated cell proliferation associated with chromosome instability. Such chromosome instability is manifested as numeric and structural chromosomal abnormalities, and as such provides the viral genome with multiple sites at which stable integration into the host genome is possible. For each of these molecular events, both direct and surrogate biomarkers have been studied to varying extents, with often small study cohorts, and with varying success of translation into possible screening tools, as reviewed recently by Wentzensen and Doeberitz (*Dis. Markers* (2007), 23 (4):315-30). Of particular note, levels of expression of $p16^{INK4a}$ by immunohistochemical methods in both lesions and exfoliated cells has performed well within an ASCUS/LSIL triage study and additional studies are planned to evaluate biochemical methodologies for $p16^{INK4a}$ expression analysis for translation into a technically feasible screening tool.

As for most cancers, cervical cancers exhibit a variety of nonrandom chromosomal abnormalities, and DNA aberrations as revealed by conventional karyotype analysis, molecular cytogenetic analyses (FISH, chromosomal comparative genomic hybridization [CGH], and array-CGH], and a variety of molecular biologic analyses, each with their own set of limitations. Conventional karyotype analysis of cervical cancer specimens has indicated the nonrandom involvement of structural abnormalities of chromosomes 1, 3, 5, 11, and 17, primarily as deletions of the short arms, except for chromosome 5 where an isochromosome of the short arm is evident (resulting in an overall gain of 5p) (Atkin N B., *Cancer Genet. Cytogenet.* (1997), 95 (1):33-9). Application of CGH and more recently array-CGH to cervical cancer specimens by several groups have delineated commonly gained and deleted regions though with the frequency of the gain/lost varies markedly between the studies (Table 2) (Allen D G, White D J, Hutchins A M, et al., *Br. J. Cancer* (2000), 83 (12):1659-63; Heselmeyer K, Schrock E, du Manoir S, et al., *Proc. Natl. Acad. Sci. U.S.A.* (1996), 93 (1):479-84; Kirchhoff M, Rose H, Petersen B L, et al., *Genes Chromosomes Cancer* (1999), 24 (2):144-50; Lyng H, Beigi M, Svendsrud D H, et al., *Int. J. Cancer* (2004), 111 (3):358-66; Ng G, Winder D, Muralidhar B, et al., *J. Pathol.* (2007), 212 (3):325-34; *BMC Cancer* (2004); 4:5; Scotto L, Narayan G, Nandula S V, et al., *Genes Chromosomes Cancer* (2008); Scotto L, Narayan G, Nandula S V, et al., *Mol. Cancer* (2008), 7:58; Umayahara K, Numa F, Suchiro Y, et al., *Genes Chromosomes Cancer* (2002), 33 (1):98-102; Alazawi W, Pett M, Strauss S, et al., *Br. J. Cancer* (2004), 91 (12):2063-70). In Table 2, alterations are those found in at least two independent CGH and/or array-CGH studies of cervical cancer. Respective data for premalignant lesions were then listed. Areas where no study was conducted are denoted with the symbol "–".

TABLE 2

Summary of Genomic Copy Number Alterations in Cervical Cancer Specimens Detected by CGH and/or Array-CGH*

| Chromosome | Change | ASC-US | LSIL (CIN1) | HSIL (CIN2/3) | Cancer |
|---|---|---|---|---|---|
| 1p | Gain | — | 0-79% | 18-80% | 27-45% |
| 1q | Gain | — | 0% | 18-21% | 20-50% |
| 2q | Loss | — | 13-26% | 18-33% | 31-57% |
| 3p | Loss | — | 0% | 3-8% | 20-56% |
| 3q | Gain | — | 0-6% | 8-48% | 40-90% |
| 4p | Loss | — | 19% | 18-21% | 25-40% |
| 4q | Loss | — | 13-47% | 12-53% | 20-36% |
| 5p | Gain | — | — | — | 30-58% |
| 6q | Gain | — | 26% | 18-43% | 20-38% |
| 8q | Gain | — | — | 18% | 25-41% |
| 9q | Gain | — | 47% | 12-45% | 20-25% |
| 10q | Loss | — | — | — | 16-31% |
| 11q | Loss | — | 19% | 12-27% | 25-67% |
| 13q | Loss | — | 21% | 18-25% | 20-43% |
| 17p | Loss | — | 0% | 0% | 25-30% |
| 19p | Gain | — | — | — | 17-35% |
| 20p | Gain | — | — | — | 18-45% |
| 20q | Gain | — | 32% | 12-47% | 26-65% |
| Xq | Gain | — | — | — | 17-34% |

For several regions, minimal regions could be identified (e.g., 3q26 and 8q24), but not for others (e.g., 5p), and for 3q26, the candidate target gene of the gain/amplification is thought to be the gene encoding the RNA component of telomerase (TERC) (Sugita M, Tanaka N, Davidson S, et al., *Cancer Genet. Cytogenet.* (2000), 117 (1):9-18). Follow-up FISH analyses were performed in several studies to confirm the locus gain/loss using appropriately mapped probes (Caraway N P, Khanna A, Dawlett M, et al., *Gynecol. Oncol.* (2008), 110 (1):37-42; Heselmeyer-Haddad K, Janz V, Castle P E, et al., *Am. J. Pathol.* (2003), 163 (4):1405-16; and Hopman A H, Theelen W, Hommelberg P P, et al., *J. Pathol.* (2006), 210 (4):412-9). Importantly, it is gain of 3q, 5p, and 20q that comprise genetic lesions homogenously detected in multiple biopsies of individual tumors. Even fewer studies have identified regions of the genome that are gained/lost in premalignant lesions indicative of their possible roles early in development of the disease (Table 2). Comparable CGH and array-CGH studies for other HPV-associated cancers have been performed and while the studies are much fewer in number, it is clearly apparent that some chromosomal abnormalities are shared between these diseases. For anogenital HPV-associated cancers, these include gain of 1p, 1q, 3q, and 20q and loss of 2q, 4p, 11q, and 13q in anal cancer and premalignant AIN lesions, and gain of 1q, 3q, 5p, 6q, and 19p in vaginal cancer (Gagne S E, Jensen R, Polvi A, et al., *J. Acquir. Immune Defic. Syndr.* (2005), 40 (2):182-9; Habermann J K, Hellman K, Freitag S, et al., *Cancer Genet. Cytogenet.* (2004), 148 (1):7-13; Haga T, Kim S H, Jensen R H, Darragh T, Palefsky J M., *J. Acquir. Immune Defic. Syndr.* (2001), 26 (3):256-62; Heselmeyer K, du Manoir S, Blegen H, et al., *Br. J. Cancer* (1997), 76 (10):1271-8; Palefsky J., *Adv. Dent. Res.* (2006), 19 (1):99-105).

Since FISH is a more sensitive and robust molecular cytogenetic technique than CGH, several groups have initiated studies to determine at which stage in the disease, the common genomic abnormalities are detected. To date, the gain of 3q, 5p, and 20q have been assayed (Table 3), being the most commonly and consistently observed genomic copy number alterations in cervical cancer, which are also found in the other anogenital cancers (Mian C, Bancher D, Kohlberger P, et al., *Gynecol. Oncol.* (1999), 75 (1):41-6). Again it is apparent that great variability occurs in the reported frequencies, which can be mostly accounted by the use of differing cut-offs for the presence/absence of the abnormality. Of note, Heselmeyer-Haddad et al. also developed algorithms to permit classification of HSIL specimens, that were dependent on the cut-off used. Overall though, there is evidence that these abnormalities are present in precancerous lesions and may have roles in cervical carcinogenesis. Indeed, in a follow-up study by Heselmeyer-Haddad et al. (*Am. J. Pathol.* (2005), 166 (4):1229-38) of precancerous used pap smears (total of 59), gain of 3q (TERC) was associated with progression of CIN1/CIN2 lesions to more dysplastic lesions, while none of the CIN1/CIN2 cases that regressed showed the abnormality, using cut-offs re-established for used cervical smears. The sensitivity of prediction of progression was 100% and specificity was 70%. Additionally, gain of 3q was found in 33% of cytologically normal smears from women who at later times displayed CIN3 or cervical cancer. Thus, at least for gain of 3q, there is preliminary evidence that this genomic lesion may serve as biomarker of disease progression.

TABLE 3

FISH Analysis of Gain of 3q, 5p, and 20q in Premalignant and Malignant Cervical Cancer Specimens

| Study | Specimen Type | Region | ASC-US | LSIL (CIN1) | HSIL (CIN2/3) | Cancer |
|---|---|---|---|---|---|---|
| Mian et al, 1999 (33) | 22 cervical smears | 3 | — | 20% | 41% | — |
| Heselmeyer-Haddad et al, 2003 (26) | 57 thin-layer slides | 3q26 (TERC) | 0% | 7% | 92% | — |
| Hopman et al, 2006 (27) | 30 paraffin sections | 3q26 (TERC) | — | — | 18% | 54% |
| Caraway et al, 2008 (25) | 66 liquid-based specimens | 3q26 (TERC) | 13% | 70% | 100% | 100% |
| Scotto et al, 2008 (21) | 144 frozen/paraffin sections/cervical smears | 5p | 0% | 0% | 26% | 63% |
| Scotto et al, 2008 (20) |  | 20q | 0% | 21% | 28% | 55% |

As mentioned above, it is HPV infection that is thought to lead to chromosomal instability (resulting in the abnormalities described above) and ultimately transformation. To this end, associations between HPV infection and particular genomic abnormalities have been assessed. A recent FISH study combined detection of the HPV genome with the detection of 3q and 8q gain in 235 residual liquid cervical specimens (Sokolova I, Algeciras-Schimnich A, Song M, et al., *J. Mol. Diagn.* (2007), 9 (5):604-11). This study showed an increase in the number of "double positive" cells (positive for both HPV and 3q and/or 8q gain) with increasing degree of dysplasia and using a cut-off of four cells, that 80% of CIN2/3 cases were "double positive". A previous study indicated that integration of the HPV genome into the host genome was associated with 3q26 (TERC) gain.

Overall then, there exist genomic abnormalities (gain of 3q, 5p, and 20q) that are shared to some extent in several HPV-associated diseases, and for which there is some preliminary evidence suggesting an early role in carcinogenesis.

In interphase FISH, a single-stranded fluorescent-labeled nucleic acid sequence (probe) complementary to a target genomic sequence is hybridized to metaphase chromosomes and interphase nuclei to detect the presence or absence of a given abnormality (Patel A S, Hawkins A L, Griffin C A, *Curr. Opin. Oncol.* (2000), 12 (1):62-7; and Carpenter N J, *Semin. Pediatr. Neurol.* (2001), 8 (3):135-46). The chief advantage of FISH is that it can be applied to non-dividing (interphase) cells and a variety of specimen types. Depending on the color scheme and placement of the probes (spanning or flanking the genomic region of interest), interpretation of hybridized nuclei preparations can involve counting of hybridization signals per nucleus (genomic gain/loss), identification of fusion hybridization signals (rearrangement), or identification of signals that break apart (rearrangement). For the most part, in a clinical laboratory setting, FISH is considered an adjunct to traditional G-banding metaphase chromosome analysis. Even in this capacity, the impact of FISH-based assays on patient management is well established for a broad range of cancers for both diagnostic and prognostic purposes. To date, two FISH-based tests have been FDA-approved in cancer: PATHVYSION® (Abbott Molecular, Inc./Vysis, Inc.) for the detection of HER2 amplification in breast cancer to assist in treatment decisions, and UROVYSION™ (Abbott/Vysis) for the detection of aneuploidy associated with bladder cancer in urine specimens. In these tests, a FISH-based assay is being utilized in clinical management of patients in conjunction with morphologic examination (pathology and cytology respectively) and not metaphase chromosome analysis. In addition, both assays involve enumeration of signals per nucleus (cut-offs established by the manufacturer based on large cohort studies), which lends itself for automation using systems such as the Metafer (MetaSystems). Such systems are currently in routine use in clinical laboratories for assays such as UROVYSION™. Thus, commercial precedence exists for the use of highly sensitive FISH-based assays in diagnostic and prognostic clinical settings in solid tumors.

While HPV infection plays a major role in the development of cervical and anal cancer, additional host oncogenic events are involved. Molecular cytogenetic and genetic studies have identified a number of genomic abnormalities that are shared between these cancer types that potentially harbor oncogenes or tumor suppressor genes. For several of these regions, candidate genes have been suggested though none have experimentally been confirmed to have such a role. Despite this, these abnormalities serve as biomarkers of HPV-associated cancers, but it is unknown at which stage in the etiology of these cancers, these abnormalities are observed. HPV-associated cancers are thought to follow a course from initial infection, to persistence of the infection, to progression into a precancerous lesion that ultimately becomes invasive cancer. For cervical cancer, there is reasonable evidence to suggest that gain of 3q is a genomic alteration that is associated with progression of the disease into a precancerous lesion and that detection of this abnormality in cervical cytology specimens may differentiate between lesions that will progress versus regress. There is also some preliminary evidence supporting a similar role for gain of 5p and 20q in cervical cancer progression.

The present invention can provide improved screening programs for HPV-associated cancers, particularly through the identification of biomarkers associated with HPV-associated cancer progression. In specific embodiments, as described herein, the present invention provides for the use of FISH-based assays in the evaluation of biomarker indicative of HPV-associated cancer in cervical and anal cytology specimens, such as the gain of 3q, 5p, and 20q. The invention also can provide for determining whether detected genetic alterations are biomarkers of HPV-associated cancers that can successfully stratify patients into those that require additional treatment versus those who do not. In particular embodiments, this can be accomplished through use of a robust, sensitive, and specific FISH-based HPV-associated cancer detection test (FHACT) that can significantly contribute to clinical decision making in patients with abnormal cytology diagnoses, impacting clinical management and cost of care. The present invention also can allow for evaluating the commonality of genetic alterations in HPV-associated cancers and obtaining valuable information on possible common roles of these abnormalities in the etiology of the diseases.

In certain embodiments, the present invention can provide a probe set or panel of probes for detecting biomarkers in a sample indicative of HPV-associated precancer or cancer. Particularly, the probe set comprises a plurality of labeled, distinct genomic regions, wherein each of the distinct genomic regions can be individually capable of hybridizing to material present in a sample. Specifically, the genomic regions in the probe set can be regions wherein an alteration therein is correlated to one or more types of HPV-associated cancer. The probe set can be used in a FISH-based testing algorithm to identify biomarkers indicative of HPV-associated cancer and thus provide a tool for diagnosis and prognosis of HPV-associated cancers in various stages of the cancer cycle (e.g., precancer, early stage cancer, and late stage cancer).

The invention also provides methods of utilizing the probes for identifying biomarkers indicative of HPV-associated cancer. Various materials can be used in carrying out the methods of the invention, and the following discussion provides only certain embodiments encompassed by the invention. Further embodiments also are intended to be encompassed by the invention.

As noted herein, the present invention can related to specific probes useful in identifying biomarkers indicative of HPV-associated cancer. Such probes can be prepared according to various methods not limited to the exemplary embodiments described herein. In certain embodiments, the methods of the invention can be carried out using one or more probe sets commercially available. In other embodiments, the inventive methods can be carried out using specially prepared probe sets according to the invention. In still further embodiments, combinations of probe sets can be used. As used herein, the term "probe set" is intended to mean a single set and/or two or more sets, wherein each set can comprise a plurality of nucleic acids of varying lengths that are homologous or complementary to genomic regions (e.g., DNA fragments).

The probes of the present invention hybridize to genomic DNA, particularly a target genomic region as disclosed herein. It is recognized that for two single-stranded DNAs to hybridize to each, such as for example, a probe and a target genomic region as disclosed herein, one single stranded DNA must be complementary to the other DNA single stranded DNA. Thus, the probes of the present invention encompass nucleic acids that are complementary to either strand of the double-stranded DNA of the target genomic regions as disclosed herein. While the probes of the present invention can be fully complementary to all or at least a portion of a target genomic region of the present invention, the present invention encompasses probes that are not fully complementary to a target genomic region but that can specifically hybridize to the target genomic region under hybridization conditions disclosed herein or otherwise known one of skill in the art.

In specific embodiments, probes useful according to the invention can be prepared as described below. The following description specifically can relate to 3q, 5p, 20q, and cen7 probes, but the invention also encompasses similar modes of preparing further probes that can be useful according to the invention. The following description may refer to the plurality of probe sets as a probe "cocktail", but such term is not intended to be limiting in scope and rather is used to simply reference the group of probes that can comprise one or more probe sets. In specific embodiments, 1 μg of each probe DNA mixture can be labeled by nick translation by conventional methods with the respective fluorochrome used as a label. For BAC-based probes (e.g., 3q, 5p, and 20q), labeling can be performed for 16 hours. For the plasmid-based probe (e.g., cen7), labeling can be performed for 6 hours. An aliquot can be checked by gel electrophoresis to ensure that the size of the labeled fragments is approximately 100,300 bp. A small equivalent aliquot of each labeling reaction then can be mixed and ethanol precipitated in the presence of Cot-1 DNA and human placental DNA. Following re-suspension in a hybridization mix (e.g., 60% formamide, 10% dextran sulfate, 0.2% SDS, 2×SSC), the probe cocktail can be hybridized to a control slide (as further described herein) and scored manually to confirm adequate labeling of each probe. If all differentially-labeled probes are well visualized and of roughly equal intensity, the remainders of each labeling reaction can be mixed in equivalent amounts. If unequal signals are observed for the probes, then upon mixing of the four probes, appropriate adjustments can be made to the volume of each added. In either case, Cot-1 DNA and human placental DNA can be added prior to ethanol precipitation with 0.3M NaOAc. The formed pellet can be re-suspended in 50 μl hybridization mix. On average, 1 μg (1 μl) of each probe may be sufficient for approximately 10 hybridizations of circles covered by 18 mm$^2$ coverslips.

For each new "lot" of probe cocktail prepared, hybridization of a control slide can be performed for titration of fluorochromes as described above. In addition, for each batch of ten specimens submitted to FHACT, a control slide preferably can be hybridized to control for hybridization conditions. The control slide can comprise two areas of hybridization, one containing nuclei of normal peripheral blood lymphocytes (PBL) (negative control) and the other of the cancer cell line. For example, in relation to cervical cancer, CaSki can be used and is known to exhibit gain of 3q and 5p (positive control). The normal peripheral blood lymphocytes on the control slide typically can comprise, for example, an equimixture of PBL from three females and three males.

Various methods can be used in specimen preparation. For example, cervical cytology specimens for FHACT can be received in PreservCyt™ and SurePath™, alcohol-based preservation media used routinely for the preservation of cervical specimens in preparation for cervical thin-layer cytology. For FISH, the specimen cells preferably can be transferred into Carnoy's fixative, (3:1 methanol:acetic acid), which removes most of the cytoplasm leaving nuclei open to hybridization with the DNA probe. The Carnoy's fixative evaporates rapidly facilitating the spreading of nuclei when making air-dried slides. Thus the cells of the coded specimen (approximately 0.5-1 ml) can be pelleted (such as by centrifugation), re-suspended in fixative, and left for about 30 minutes. Alternately, the cells can be stored overnight of longer (e.g., at 4° C.). The fixative then can be changed at least two times just prior to use or for longer storage (e.g., −20° C. for up to 3 years). In specific embodiments, about 0.5-1.0 ml residual cytology specimen can be sufficient material (nuclei) for an average of about 4-20 hybridization areas having a dimension of about 18 mm$^2$.

Specimen slides can be prepared according to a variety of methods. In specific embodiments, just prior to slide preparation, the cells can be pelleted and re-suspended in approximately 30 μl of fixative depending on the size of the pellet, of which <8 μl is applied to one circle on the plus side of a two-sample coated slide. A second specimen can be applied to the other circle. The slides can be air-dried for one day prior to hybridization.

Prior to hybridization, slides can be with pepsin (e.g., 0.004% in 0.01N HCl) at for a time of about 15 minutes at a temperature of about 37° C., washed twice in PBS at room temperature (RT) for 5 minutes each, post-fixed in 1% formaldehyde for about 5 minutes at RT, dehydrated in an ethanol series (e.g., 70% and 100%) for 2 minutes each at RT, and air-dried. The FHACT probe cocktail in hybridization mix (50) then can be applied to each target area of the slide (a circle), coverslipped, and sealed (such as with rubber cement). The probe/hybridization mix and specimen can be co-denatured (e.g., at about 80° C. for 2 minutes) and incubated overnight in a humidified chamber (e.g., at about 37° C.). After removal of the rubber cement and the coverslip, the slide can be submitted to two washes in 2×SSC plus 0.1% Tween-20 (e.g., 45° C. for about 5 minutes), and rinsed briefly in distilled water at RT. The slides then can be air-dried, DAPI counterstain applied, and coverslipped. Slides preferably are kept in a light-sensitive box until scoring is performed.

For each hybridization batch, the control slide initially can be scored using any suitable equipment type, such as an epi-fluorescence microscope equipped with filters to view the red, green, blue, and gold hybridization signals arising from the labels used in this embodiment. The microscope also can include a CCD camera. An exemplary operating system is the Isis Imaging Software (available from Metasystems).

The slide first can be examined for cell density, background, nuclear morphology, and hybridization signal strength. Using established criteria (e.g., derived from experience in performing FISH with other probes on clinical specimens), the quality of hybridization can be ranked and, if suitable for analysis, is scored. In one method for scoring, 300 or more nuclei are consecutively scored where nuclei are not scored if they are: 1) overlapping such that the signals belonging to each nucleus cannot be distinguished; 2) are scratched or otherwise physically damaged; 3) are partially covered by fluorescent debris which might obscure signals; 4) have signals which are pale or irregular and cannot be distinguished from background; and 5) do not have at least one red, one green, one blue, and one gold signal (i.e., at least one signal for each label color used). For scoring, each signal must be on or touching the DAPI-stained nucleus, be larger than background spots, and be a single spot, a closely-spaced doublet (less than one signal-width between), a closely-spaced cluster, or a continuous string. The nuclei are scored according to the signal patterns obtained for each probe set, where the expected normal pattern would be two signals of each color. Once it is determined that the controls are within the established ranges, the specimen slides are scored in a manner that is essentially the same as the control slide except that 300 or more nuclei are scored. In this embodiment, the patterns of hybridization (# red signals; # green signals; # gold signals; # blue signals) and the number of cells exhibiting these patterns are recorded. The number of cells with an abnormal pattern (e.g., more than two signals of red, green, gold, and/or blue) with the respective abnormality are calculated.

In specific embodiments, it can be useful to establish a basis for preliminary cut-offs. In one embodiment, abnormal and normal specimens can be used to establish the cut-off that will provide optimal sensitivity and specificity for the separation of the two specimen types. The cut-off can be determined for each abnormality as well as for various combinations of the four. Specimens also could be called positive or negative for each abnormality as well as for various combinations of the four.

The present invention can be carried out using samples (i.e., specimens) in a variety of forms. In certain embodiments, the test sample comprises all or part of a biopsy or biopsy specimen. In other embodiments, the test sample comprises tissue that is fresh, frozen, or formalin-fixed paraffin-embedded (FFPE). In further embodiments, the test sample comprises all or part of a biospecimen, such as cytology, fresh frozen biopsies and larger excisions (LEEPs), cervical secretions and blood, to name a few. The test sample particularly comprises genetic material. Preferably, the test sample comprises material in some form capable of hybridizing to the genomic regions represented on the probes used according to the invention. In specific embodiments, the test sample comprises DNA or fragments thereof. Tests samples include, for example, any tissue or fluid sample suspected of comprising an HPV-associated cancer or precancer. In a one embodiment of the invention, the tests samples are tissue or fluid samples from the cervix or anus. In other embodiments, the tests samples are tissue or fluid samples from the vulva, vagina, penis, oropharynx, pharynx, or any other tissue that is suspected of comprising an HPV-associated cancer or precancer.

EXPERIMENTAL

Specific studies were performed in development of the inventive FISH-based HPV-associated precancer and cancer detection test (FHACT). The test is useful for detection of HPV-associated precancer and cancer.

Initially, specific regions and appropriate probes were identified for use in the FHACT test. As described above, gain of 3q, 5p, and 20q are genomic abnormalities that are common to some extent in several HPV-associated diseases. As also noted above, there is evidence that, along with HPV, such abnormalities can have an early role in carcinogenesis. At least for 3q gain, there is some indication that it may represent a biomarker for distinguishing cervical lesions that progress versus those that regress. To this end, a probe was designed that is informative for the respective region incorporating TERC, a target gene associated with the gain. The seven bacterial artificial chromosomes (BACs) comprising the 3q probe were selected using the UCSC Genome Browser of the human genome sequence NCBI Build 36.1 (http://genome.ucsc.edu), based on genomic location (3q26), on lack of noted chimerism, and on relative content of repeat sequences. The cen7 probe fluorochrome was changed due to the inclusion of additional probes (5p and 20q) and taking into consideration the differential fluorochrome intensity and the ease of enumeration of the different sized signals.

As no candidate gene/region has been identified to date for the 5p gain, a probe was designed for a region on 5p15 comprising four BACs. This probe was grown, prepared, and labeled at CGI with SpectrumGreen™ (green).

For 20q, while two minimal regions of gain have only recently been identified (20q11.2 [4.1 Mbp] and 20q13.13 [3.1 Mbp]), a single BAC (RP11-30F23) mapping to 20q13.1 was used to confirm 20q gain in premalignant lesions. The present inventors have identified a probe for 20q13.1 for use in the FHACT comprising three BACs. In this case, the probe can be labeled with EnzoGold525™ (gold).

For each probe generated to date, the size of the respective labeled product was confirmed and, if needed, optimized in an additional labeling reaction.

As in the routine development of any probe to be utilized in a clinical FISH-based assay, labeled probes are initially hybridized to normal peripheral blood lymphocyte preparations (includes both interphase and metaphase cells). This is two-fold in purpose: to confirm the expected chromosome hybridization localization, and to rule out chimerism. The three probes, hybridized as a cocktail, were found to be non-chimeric and to hybridize to the correct location on reverse-DAPI-stained metaphase chromosomes. A representative image of normal lymphocyte metaphase and interphase nuclei hybridized with the four probes, confirming lack of chimerism and correct chromosomal site, is shown in FIG. 1.

Following the initial routine work-up of probes for use in FISH-based assays, several residual cervical smear cells in PreservCyt™ with known and unknown cytology were commercially obtained. A representative FISH image of interphase nuclei in a residual cervical cytology specimen with no intraepithelial neoplasia or malignancy showing a normal diploid signal pattern for all four probes is shown in FIG. 2. It also shows those obtained for a CIN3 specimen, with an abnormal pattern of 3R, 3G, 3Go, 2B. This abnormal pattern is indicative of gain of 3q, 5p, and 20q. Thus, the 3q, 5p, 20q, and cen7 probe cocktail performs well in the specimen types to be studied with no clear evident hybridization problems.

Cut-offs were not established for the 3q, 5p, 20q, and cen7 probes since, under practical concerns, these typically need to be established using the specimen type to be used in the assay due to artifacts within the specimen type that may interfere with the scoring criteria. This would be residual cervical/anal/oropharyngeal cytology specimens in PreservCyt™ and SurePath™ media.

For all probe sets, the genomic sequences spanned by each respective probe set and expected to serve as fluorescence in-situ hybridization targets are:

3q26: chromosome 3, nucleotide 170,547,508 to nucleotide 171,451,296 (SEQ ID NO: 1);

5p15: chromosome 5, nucleotide 9,134,024 to nucleotide 9,735,238 (SEQ ID NO: 2);

20q13: chromosome 20, nucleotide 42,415,838 to nucleotide 42,908,890 (SEQ ID NO: 3); and Cen7: chromosome 7, nucleotide 61,607,721 to nucleotide 61,608,041 (SEQ ID NO: 4) (All nucleotide positions are according to the March 2006 NCBI Build 36 (hg18)).

The clones used for probe preparation and their corresponding nucleotide positions with the chromosomes 3, 5, 7 and 20 are provided in Table 4. For the cen7 probe, the fragment of human DNA contained within the plasmid is 321 bp in length and exhibits greatest homology to chr7: 61,607,721-61,608,041 (99.4%). Due to the well-known repetitive nature of sequences at and near centromeric regions including cen7, the cen7 probe of the present invention is expected to hybridize to additional regions in the vicinity of the centromere of chromosome 7 that exhibit high homology to the cen7 probe. Additional sequences in chromosome 7 that also exhibit high homology include, for example: nucleotide 61,604,830 to nucleotide 61,605,150 (97.5%); nucleotide 61,606,019 to nucleotide 61,606,339 (98.8%); nucleotide 61,607,041 to nucleotide 61,607,361 (97.5%); nucleotide 61,610,103 to nucleotide 61,610,405; nucleotide 61,612,138 to nucleotide 61,612,450 (92.4%); Due to the high homology, these sequences are expected to serve as additional hybridization targets of the cen7 probe with the entire region spanned by the sequences of high homology being chromosome 7 nucleotide 61,604,830 to nucleotide 61,612,450.

TABLE 4

Clones Used For Probe Preparation and Corresponding Nucleotide Positions on Chromosomes

| Chromosomal Segment | Clone | Chromosome | Start Nucleotide[1] | End Nucleotide |
|---|---|---|---|---|
| 3q26 (Red) | 1 | 3 | 170,547,508 | 170,734,205 |
| | 2 | 3 | 170,655,688 | 170,810,114 |
| | 3 | 3 | 170,776,548 | 170,968,089 |
| | 4 | 3 | 170,830,768 | 170,980,869 |
| | 5 | 3 | 170,975,610 | 171,133,930 |
| | 6 | 3 | 170,099,036 | 171,303,928 |
| | 7 | 3 | 171,272,078 | 171,451,296 |

TABLE 4-continued

Clones Used For Probe Preparation and Corresponding Nucleotide Positions on Chromosomes

| Chromosomal Segment | Clone | Chromosome | Start Nucleotide[1] | End Nucleotide |
|---|---|---|---|---|
| 5p15 (Green) | 1 | 5 | 9,134,024 | 9,322,468 |
| | 2 | 5 | 9,273,776 | 9,469,235 |
| | 3 | 5 | 9,404,142 | 9,596,539 |
| | 4 | 5 | 9,579,237 | 9,735,238 |
| 20q13 (Gold) | 1 | 20 | 42,415,838 | 42,605,120 |
| | 2 | 20 | 42,578,015 | 42,755,125 |
| | 3 | 20 | 42,735,160 | 42,908,890 |
| cen7 (Blue) | 1 | 7 | 61,607,721 | 61,608,041 |

[1]All nucleotide positions are according to the March 2006 NCBI Build 36 (hg18).

A number of journal articles are cited herein to provide references for various disclosures. It is understood that all cited articles are intended to be incorporated herein by reference in their entirety.

Many modifications and other embodiments of the inventions set forth herein will come to mind to one skilled in the art to which these inventions pertain having the benefit of the teachings presented in the foregoing descriptions. Therefore, it is to be understood that the inventions are not to be limited to the specific embodiments disclosed and that modifications and other embodiments are intended to be included within the scope of the appended claims. Although specific terms are employed herein, they are used in a generic and descriptive sense only and not for purposes of limitation.

SEQUENCE LISTING (4 sequences)

SEQ ID NO: 1 - DNA, 903789 bp, Homo sapiens
ataattgataaagaatgaggaggttctctacatgtggatatggaatgatcagcaagacaaatggttaactggaaaaaagcaaactgcagaatggtatactcagtctatactaatgtaaaaaagagaaacaacatatatgcatttgcttctacatgcatatcatatatttagagagatgatacacaataaaaacattggttgtacttcatgggggggcagttagtggatggagacaggtatgtttagttaattaaataaatatttaaaagaattagctacatagagaaagatatccaaaatattactacaaaaataaatcaaataagtgaatatataggtacacatttgaaagaaaaagatttttgtccgcatacacacaatgtctgtgtgtgtgcatgcattttcctgtaaactttttggaatgatatgcaagatattgttgaaactatagagagacacggagtatttactaggggaaaaaagacttctgcactgcttgaattttactatatgcatgtgtttctttcataatcatactaaccacaaataaaagacaaaaaatgaggaggagttagaattaactgaaagatatctacaagagaagttatctacccttaaatgaattgaaatgacccataacaaaagcattcaattactctcaccttcccttcttctgattcaaatgtagatgagttcactttgaaaaagaaaatttctattagaaattctgtgtggatgacaggcctctgtgaacataagagcaagagctcagggaatggatttgtctggttcgccacataaacgcccaataaatacgtgttgactgactgacaagccccattgctaagcatgctacagaatatgtgcaaaatagcctacttgagcagtctgccatcccatgaagacattcgattccaacaggctagaacttaattggaaaaatatgggcagaacaggatgacaagaccattctaacaaagtcctctgaaaatgggcgattatttctctgcttatctacagggcatcttcccagcaagacactgagccttaaaaaaaaatatttctagcaaccgaaataactctattccatatgcatttgtcaatgttccctgagaaagcagtggtagtgtatgtgagagtggagaaagatgggaatattgcagattctgtctgtgtgtgcacacatgtgcataaggaccagatgaggtgaatgcccttagaaaaattagtatgtttttattcactgaagtaaaaagaggctgtttctgggtgtggagtgtgaaaaacaatcttactactttatagtcacacctcataacataatcctgtaacacctactgacccaggatctccaagaaagggatagtgttaattctattgcacttatgggaaatttggggaatatgtagccaagatccaccagccctgaggtcctgactcatagccttaactatgagatttccctcctgatttgaggatgagtagaatatactcacaccttttcatgggattctacctcgttcttcttcaggaactacaaagcaatcctttaaagatgagtggtattaacactgtaattactattattatttatttcataagagaagtaaacattttatatgtagacttccttgccagacagctaatgtaaaaatgaatatttcaattctgagtcaaagaaaagattaataacttctacacatttattgccatagaccttttatttgcaatcatttcaaaaaacagactgtctttaaaacattttagtcaaataattatgaagaacagaacaaatgccttagaatgactgcatcttcagcagcatgatacattactatttcggtctacctccccctgccctcatgtcatatttgggtacttttatttttcaaatattgagttgttttactgcctgcacagttaaggctatgattggttgttaaccacttctctaaatacttcaggagactgagaaccagagtggaactgcatttttttacatcaatataaagtcatgttcacccccattcccctccctctcatcctcccctttcccccctcccccagtgtttttctccctcacttcttagacgcatttggtaacaatcaggcttttattttaaggagccctaagataaggtatctgtgagctccacacttggagtaattgatcacatttgtttcctgttcgtaggttagacccctccttcttgctctttttcttttttttaaacttggcatgtttctcattaccctctgccttgttagcctagtagaaattttctactgtggagagtgaaaacaggacgatactattacaaacctcgtctagtcggtgacagcagcccctctctttctccaggaacattgggccacttcacgctctagtggggggccctcctatggatacaggtatgcatgcctgtaactgaaggaggttctgtggcatttgcttggtgttcacatgtttaattttcacagaactgtgctgattcataccgagactgttctccaggatgacaacattgttatcatatgactcaaattgccccacctcatttcatttgggaatgttagctcaggttcaataaccatcagctgccaattctgtaaaagaagacctgtatatttcccgtctatgctttctagataaattgtaatcggcagcattttactagccctgtcaggtggggcttaattgcagatattgtctaaggaaagaaaaatgcagaagaatgaacgatcttttcttctttgagtctctgtgggccaatgaatatgagacagggactcagtcattttcctatcaaggcttcaatcacaacaatccaagttaaaaactccagtaactcaatgtaaaatgaaatgcaagccctgccattattttcctgtttggggctgagagagataccaaaataaattgtttataatggctacaattcaattaatatatctacttataatatcaatatttatttataaaaatatgatagagtctaatgaagtgatatgcagtttatgcaagaatcttaacaaataatcctttacctgagtggtattccttcaacattcaaagtttcaagactatctgaacaattccctattttgtttatttggttgttagttggttttgtgcttgttattctcttacacttcacatgtcaacacctttacataagcagccaacaaaagcagcatattttaacagaactaaaaataaattaaaattcaggaagagacttggaacctggtctaagctctacccccaaagtagttgggtgaccttgagcaagtaactgacccttcttgaccttcagtgtcctcatttataaaatgagtaggctgggccagatggctccacagtggctttcagtgcttccttctctgtcataactaacattgagctgaatcacactgtaaaagattgagtcttcgagattttccaaggctatgtagaatacaatagccagtagccacatgcagctactaagtgcttgaaatgtggctagtccaaattatgaggtgttataagtgtgaaatacataccagatttcaaagattttagtacaaaataggtacagtatttcagtcatttagtttttgcatttagaaattacaatattttggatcctctggttagatatattatttaaattataccttttttttactttttataaatgcagctgttacaacattttcaattacttatgtgactcatgttatatctctatcggatggtaaagtaataacaggtctatggctgtgtatttaccacagagagaattaaagtggaaagactctgaaatattttatttactgggggtctttcataataaaacaaaaatctcttgttttctggataaaaatatccaggtcaaagccatctctgaagcacccatgctactcaataaagaacactaaatgttaaaaagtgttgtttcataaaattatagtactagtaacccacatataacctaaagagcttaaaaattgccccaaatctcataattttctcatctaactaatccgatttacattcctgaacaccagaattattcattcattatattctttacaatgtttatattttaaaaatttagaaaaacacattaatgaaaagatttttttatataaattatcttttgtttcttaatatagatgtacccactttattctgacaatccctttgctgaagaacttctgaaggactgtggctaaagatcaaatcttaacatatttttgtcaatgaatacctggataatttaattattaaggaaaaatcaaagttttgtctacataaaaaagtattgcatatctatatgatagatattttagtcaataattgcaattttgtatctaaggtgataaatctacacagtaatgtatttatgtatctttctagtaggtattaatataagagaactattcattatgctaacagtgaagtctaaccctcaaaagaagcattatctattccacattaaagtaaacccagttaatacctaaaatgaatgttttaaagtacatagaaaaatgattcagcaaaaattataattacaaagctgataacggtcatttttcttttgttaataatattcaaatgtatcccttattaaaatatgtaatcttatttttaccacactctttctcaagtgtttgaatctttgaccatccccagaacctgacgccttgtcagcctattgcaggtaaaagcttttgaagatctaccactactcttgtcctaataaggtcactgacctttcaagctcaactcctaccacccccatcttcatttcctctcctatcattagtctgaaatggcatcaactacctctcaattttccttatcccttcaatgccccacctctttagtccaaattcacctaattaggaacttaatttccttttttctctgattgaggaattgataatagatggaccctattcatctttgattcacggaaaactgcaacaatgacctcttatttaggaaggataagcatttattctagaaattgttttgtggaggccaactacagaactaagtaaaagtgatgtttttatttttattttttagctaaaacagggaaaggagaatcattcaaatctgatacgttttgtttcttttacatttcattttacatagccgtagttactaatatttaaaacaagtagattttcctgtaaggcagaaaataattgagttctaatagaagatcactgagttagatttaaagaaatatattaatggaagttaataatttcttaaaaccggtcatttttaacaattttataaaaacaatctctcacaccagaaaagacatatgtgggctaggtatctacaagtgggagtcacatattaaaggagctatctcagtaattagctaactttactatgaaattatcttcttgactctgatgtggtagtttaactgtggagttgtctaacgtaaaaactcaaagcacataaatattccttgcaatattttttttctgaaacttgttggggggaaaagtatggccttaagagttagtggtagcagaaaaaccaaaccaacaattttattccaccactaaaatttttaatgtctaatttcatatcctattcattcagggagtgaaataatcataaacatcatagtaaagcttagaagtgacaatcataataaacagtaaagacaaaccaacttcattttgtccaataggcatttgagcccatactcagagcattctgcaataggactcaggaccaaatcatttcaccaacatttttcttgcaacgaagctattcaacgcagaaaagaattagggaaatagatgacctaagaagagatgacaatttcttgattaaaaatgtccctctcaagtacacaatcttatctctctctgctctctttggtggcccatttgagctgaatgagggttagagctttgctgtctggaccaaaactatgctgatgtgacttagagcctctccccaaaagggaagttacattgttgatttatcccacgaggctacaatttattttcataaaaataaaaatcaccaaaacaagttgctaaaacactgcttttttccttctcattgaataattcatgctacataagcctaagcatggccaaaggatttggctgtttataagagatagctaatgctaaaattgcctccaactcagttatctggaaagaaagaaaatcataggataatgagtcgggaattaagaagaaagcactttaaaacacaaaattaagtgaatcaactacttcatcaattttggaaaataatgttaatactatttttgcttagaaataaaatcatttataccaaaaatcattaattattaataacaattaaaatggagaactcactctaattgagactgaggaatttaaattctgactatcttggagccccacataaaaatgtttccaaatggaggacaataaaaaaagatcggttttatacaagttgccatatttttgccttcatctcctgatgctactccaagttaaccctaaataagtaatgtaaatagctaagtaaaattcagaatcttttccaaaaggcagtagtgttataacatcaaccaaaccagctggtatgtagccaaaacattagagagggaaataattttaaaattaaaataaaatactatcttctaatcatgaagataaccttatttttttcttaggtatcttttaagaacttgcatttccacaagccaattactgtctttatacaaagcttcatatataacaatacaaactgtaaactgacatgttgtgaagctagttgaattcatcacaacataactataaatttcttctcaaatcatttaaatagtatgacatttccccccagttcttttgttgataagcagaatacactttttttcctaatatataggcaagtctcaagtttcttaagtaaatcaaagaatatttattcagtccctccatagctaaccagtagattcgcatagctgaaatcttttattgcttcttttctttctacttcacaaacctgcttatagttattacataacaacgtgagttataaagtcctgaagattttccattgagagtggaattaatctcaatgtaaatcaaagtaaaaaattaaaatattgttagaaaacaataaaaacaagatgttatagcatttttaatcctaacaccaaaaatctcaaaccccagtaaataagttcatattcacagcatatttttgactcacactaacaataatcccagaaagatctgccattcccctaggctacccaagaacatgttaaatctcaaaaacctaatgcctacagtttttctctttattccaaaaaactaatcattatatctcttccaaagttgccagaaattcctcagtccccataaagcttaatttactagttcataatatttccatatttatgtattaagctactttcataggacacaaaatgatatatttttcaaaattggcagtttctatttctctttttaagtttagtttggtcgtattacccataggttaaatcctagcctaacctttaacttgtatcttggaaataccaaaaagcttgtacctttagaaaatgtgtgcaaagtttaaaagaattcgtgttttatggctaatcatagaacgctgaggacaggtaaaatgcaaggaatgttgctagaacctcaggatgccgaaccaagtaaatggatgccatgaaaatacagctgtatatgtttgcatgggcatatgtttgttcagtttttcccccccttcctgagctggggcttcagctttaggtcattctgcaaacaagccccaggagacacacaattacactcccctggagactgaccccttagagtgcccacctgtagccaaacacagatagcatcccggcgcaatgaattagcactctaagctgattagagcagctctgcacaactctattttattgacacaatgaagagaggacagaaaagggcctgaaatgagaaaatcatttccatgctgactgaattaaaagaacaaaagagctccttgcagttgcagcattcaatttgtcgggaaaaaaggaagccacttaatggctcacaatagatctgagcagacagatgaaatttaaaacttcagcatgagtgcgattagcagcgaaacatattctaaatcatttcctccatatgcataattttgtttgattgtttagttctgtgttttacaaaaacactgggctagatgctatcttcaaactgtcttgacttttcattttgcaaaatcacagaacagtttctcattgtatgttaatgtccttggtgacaatataaattgaacacaacaagtgtggctcatgttttcctttcacctttggttttcaaaagtgaatgtataaacagaggttaatttgtggaaactaggattgcaaagtaatcttctaccaaacaacttgtaattcaaaattaaatagattatagacaacagaagcactttgacatggggtaaaaaacaaccaattattgcacccagaggctaaaaataaactgccatgttaaagtcaaatgtcatcactgatgtcttctttggtttaaaagatagcattattatcagtaaaagcaacaccgttaagacggcagtttccaagtatatgttctttttacatttttgctcaattaactattgttttacttgttctgacttataaattcctgagttaaattgaatttgaaattgatgtcaaaaaatgatcacttaataagcaaagctaacttttagatataaataccatatagcagtgaagattctctagaatatcatcttttttttttccaattttataagaaaaatctaaatgtctaaaccgtatatggaaaacagaattgattttcatgaaaggattgaatgtttgtttttgatggggatttttctcctgccaatgttaattttcagtgcctaaaaataaagagtaaaagcaaaggtcttagtttttaattactcaaaattcacagtttcattttccatgcctaagcttcttttaagaaagcttttttgtttaaagtggcccttcagacttttaacctctcatcttgactcctaatttaaatgaagaaaattcactccttctgttcttgaaacattctttgccaagtgttgaggtgcaatgtaaattgagcaaaaattgtagaacaaatcaaaagaaaaacaattactgtgagatactttgagattcaagacttggggtacattactacttaatttgctaagtgtaatttccccagagaaaaaaaaccaaggtattctaaggataataaaagcacaagtgatctcctcaacagcttccattttcttgactaaatgaggtaagagttttttgtataaaaagaaactataaagcttgtggatgttttaacaaaatcaacgtagtgtaactttgctgacagcttgtcacatttcactgactgtctgtctggggtaccgcgataacatctgcattcactcagtatgagagccgaacataagacaaaaaagtgggccctgccacggacggctccatcagtctgtcagttctgacatgtcatctgaattttttgaatcactaaacacttttgagactctggtacttattatcttttcttagtttctatactcgctcagcaatgctggaaaatgtaaaatctgcaagcaaggtagtggacgtcccaggctttttgttgtctaatccgtaggccctcattcatgctcactgttaatctcttaagacattataaaactgttagacaaagaaatgtgaatacctctgcttcttttgagaatgggaggaaaccaaggaaaatcaggatcatgctaagctattcttttcattatgaaaatggtaacttaaacctgttgcatcaaattatctataattccccacgctaaggcaaatgtttttgaagaatgaacaagagtagtgtcacataaagagaaaaatgatcacagaattttcaaaatctgccaaatttgatgtcaacagagcattgagatccttgttgccgcatttctgtttctattttttatgccatggtacatgacatatggttaagaggctttcataaaagctcataaaaaagcttaccaatacccactagtaatcattaaatagtttagataattttgctctttattaggaatcctgggaacactaagagctatataacaatagccttaaaatgtggctaacattcattaaagtgctacacatcacagattttaatgagcaattttatcctcaaaactggaaaaccttacagcatttttcctaaaagggtcaaatataagtagatcctcagagctagagagaatacttacatgaaccacataaaagagccaaagctccatttctacctcctgtttgcagtcagtcattcaggacattaagttaaaactagatgcatttgctttccaagaaatcaagacataaggaagagagaaaataatattaaaattaagaggcaattttttttctggacctcagatacctagttcccttcttcataagcacatgcttaacacctgcaaataatttcaggtatagacaaatgccctgcaaggactaattacaggtgtgcttcccacctgcatcctcaaaaaaagactaattgtgcctcagatggtcaaatcctatgaatatttgctctgaaggaaggtgacacatatattagatagataattaatttaaccaaaaccattaggtaaaaggagttacactgacatttgcctaaggaaaagaaaagataaatgaatgaaaactagagaaaataaagacagaaaaagggaagaaaggaagcaaaaaggaagaggtgaggaaaagaagtctatcatttttcactgctatattctctgggcattttgcaaacacggtagacacaccacacacactttgaagttaatatactaattaattaataatgaacaaaaataagaatgaattttggaaccatgtgttattttatgcactttaccagcgccttatgtaaatccaacttgaaaaacaattttgcatgcaaacaaaacctccctaattataagcatgggtaaatgcactggcactggcaaatccactactgcaaacagaagactttgtgactatttctcacttttcttcttttggcatattgtcgtcttgtaactctctcaagagctttgatgtaatgtcatttgcttgatgtttagtctgtgcctaaaatgtcagctgtttattatttttacatttcagcgctaacacaatggcacttcagaataaagggcagggttctgacacatctcaatgaccaaaggacttatattaaatagaggtttccattcttcctgaaaatactagggcactcattttttaaaacttagatagaccagttttcattactacataattttcttgtgacatttttgtaatctacctgtgagtggccctgtttcaaatactgtatcgagagccagcttattacatcaagaactgtatgccttctttagagccacaaaaaaaaaaaaaatcaccttttccttttatagaacagaagaccaagatggtagaagggttttgagccctaggacaagcagacaaaaagataactgtcccaaaggcagtctctctcctttctaaactgctaagcttaagggcctcctagggaggaagaatttagggcctacacgaaaattaacaggtactatttaatgcatgaaagagtaaatatagacaaagttttccaggagaactgcataaacttataagacttataacaaagttaaaaacgtaagtggctttcaaaaggataacagacaaatccacagcaacagaatcttggtgaggaacagctgatggtagaaatactatctcatttatgctaaatttttaacccttacccatgtgggtaatgaattctaacatcctactgtggcaattagtacttctttttcatctatttttctcaactggaactaactaatcctcgagcctcataccaactctactaaatctattctaccagaatttggtttaaaaacagtcatgttcagctatgtctatagcacatatcacatcataattttgcctttctttacaaaagttttaatattttaagtgtcaccttacctgattatagtaacttcatcctatttcatggaaactgaaggtgaaataacttatttttcttttctcaacacaacttagaggattgcaattggcaatcagtgctctgaggtgcttagttggactatacatagaaaccaaaactcttcaactatactttacaactgtatcttagattctcagtgagattcataacagatctgtggagcagaaactaaagtcaattggagatctatgtttctatcaatcagttatggtaggtgagtaaggaatcaaacttcaaatgaacacttgagtgaagcccaccaagtgacatcatataccacctcagtatagtacctttggtaatgtgcctgaaaaatcagtgttcaggggtccttattggagctctataatttgaatcctaacaactcatgattttcatcaagtgctttctgtatttttaacctggcttatctgtagtcaaactcaactattcttctacctttatattgctgacaatattctatagaatgaatatcttcaaaggagaatctccatgctttggaagatacaagcaaagtgaaaattctcttgttaaaatgatattcacatctggtgttctcaagattgatgccttttccaagattaaaaaaaggctctaacttcttattaaacattccaattaaatgtattactaaatccacactgttctcaatggaagcccctgcatgaagagagaccttaggctatagcagagtttgagtaagtaaagaatcatagcatgtggtagttttgtgacaatttagttcatactgcagatgctagcagacattaacattcagtcttaatggttaggagaattgaaaggagttaactacactccagggaaaccagagcctcctataactggtcttgcccttcaagttcttccttgaggaagaatctacctacactcagggaaactcaactttgggctactgttactttcaaccataaatccttaaccacataattcaagtataccccttctaatatcctgtgagttgggcagtttgccctccatttccagtagcatatattttggaatttctctgtaagaaaaaagctcctttctggcactccctagtgagatgaacccggtacctcagaccctaaaacttaaagtataataaaaaaaaaaaaaaaaaaaaagttacaccaaaaaaaaaaaagaaaaaaaaaaagaaaaaagctcctacaatttttgacatttcttatggttcaaaggcaatgatgaacagcatagctttagatgtgaaaagctgtaatagattttctgtagagtctgaatctatgaatcctcaaatttctgcccagaaagtcccaggactcactggacaaccaggtaccataattaaagaaaaatttaagaataaacaaatgactgtacaaaaagattagatgtattatcacttatctgaaatacttccatacactttatcgcaatatatttagttatgatattattctcagtgactcacagccattctcatttaacaggccattgatggagaagagcccaggggggaaaaaaaagcaaattcacaggatggccagggttgttatttcatatggaataaggtcaacatcttgttaatgggcggagtatgccttcttcatttaagacaaaacactgatgccttgggaagatacttgctgtcatgaggcatatttgttattaggttattctgaaagatgccatgtcagtccatactgaaaaagagaatgaactggaataaaagcatgcggatcttcccctagttctctaaactagatcatacttctccatgctagagaaaaccagctagattacactctggctgaagcctgaggaggcagagtttacaagacacaagagtgctgggggccaaattaaggggtagtaaaaaagtaaaagagataacccttaaaagggagctcttggaagagagttttctttcatggagttagggatgaaggagaacgctttatgaaggtttaaatgtacagctcttacctctctcaaccctgctccaccgcactacaagaacataaattaattagacacgaagccaaaacccctagtcctcctcctgtgcactgtttagggacacttactaaagtcttcagcaaaagaaccatttaaacatgaatcaatgtttcaaatatgttaggtctagtgaaggccacttcccagtggtattcagaaaggggacaatatttaattcaaggtgtggtggctctgccaacctcaagagctctaacctaaaagaatgaattccacaatccttccttcacaaggataaaaagagcacccttgactttggaaggatgatggtgatgatgattattaaaatcagtttgctttgaggtgctcactacagtttaccaagccctgctctaagctcttcacaatactttacaatgaaatattcatatttaatattcacaaaaattctatgaggtagatcctattgttaataccatttaaaagatgaggaaattgaggcaagaagtggttaagtacttgcttaaggtcacaaagctagtcagtggtagagaatttgaacacagtccatgaatctctagaactcctgctcttggtccatgtgttatactgcctcttttgctgttgttgacaaaagtccactacagccatgctacatttgagaggatcaaatgcaatattgaggctgaactaaagtcataccccgagaaagaatgcagttcatacctatatcttttcaaagatggcgaggaatagaattatctctctaaacaatttactttcctcttaaaacaaagctttggtcttaagccaccttctctgctaacatataaaatgcagagagagatgcacctatcaaaggtgctttgatttcagatatataaaacacaactagacactagtttcacacgggagaaatgataaaacaagtatctattttctatgtaatttaaagttaacttgtattcttctcaaaacatgccccaatatattaggttggtgtaaaagtaattgcagttttgccattaaaagtaattattttggaggttttgtttattgttgttggtgggcttttctcaacaacaacaataaattaaaacctccaaaaccatgacaatatagaacatgtccataaagatgaaaagaactaaagagcaggtgtaagagacagaattcgaagactcatagagttacagctacaagagacctgagtgagacttcagagggtaaagtcaaatgacttttccaagttcccaagtctgacttgtgcaaaaattcaaggttcctggcacccagcccagttttcattccagtgtatcacacagcctccctgaaacacaaaccactagacatatggcaaagaagcaagcaagggagctatgccacatgaatggccagattgttgaggaaagaggggtgggggctaggagtaaaggcctgaaggataatatggttttacagaaatctatttgcaagtagatactgcggttaccaatgtggctgcccaagagaaagaacaactgactgacagcaggaacaaaggcatggacagtctcacaaagagagacacaagagtcacagtgcttcgtgtatatcacgaatacacttcatcaagttgagaccaagaataacagtgaggaaaagcccaccatacacaagggcccctttattcttggggctttgctgtttcacacacactttacctgaggaaacattagaccttttgcttccatttctgtgggatccttttgatttttccacatttaactagcacatttcatgactatttagtgttcctatttttttgcaaattaatgttctgtgtacgctgatgacatattcggaagttaatgaaatcagatgaaaatcgcttagattaaaatttccccatttcttcactaccctgtatgccacctactgttcagccacaaaataccgcagctcatgcatcaacaaaacttcatattaatattctctaaggtggaaagactctattagccatttttttccctcctgtcctttgcttccaactgtgtttagctttgaaaccctctgacaaatggccattattctctgggctactaaaaaatttctaaactttaggggaaatgtatttggtccaaagcccaagggaataggcttgttgaattaaatgataaatatatgcatttaaggtcattagagactttatctcctgtgaaggctatatttgtcagattgatataatttctctcaactgagtacttaactccatcggccaacattattacaattattcctttccctttaagtgggagacttctggctaacaacacgtgcgctctttctggtgctgcttcttgagcgatcaaggcacacctttgtttcatttagtatgcaattttcacctctgacccaagaaatgagtcctgggcttcctgaactttattgcctgttaatagactgctggctctcttttcagcagtaatagaaatggtggagaggcatttcatttaagaggctggcagactgcagcctgaaagacaatgtcagaattaaaagtcagcctggccgaaaaactgtataaagaccacagtgacatgaaagaggaagttttccatattccaccccgagactgaacacgcagtatataaataagaacagcatcccggatctcattattttcccaccgcacaatggcagacactctgaatggtgctaagtgattgatctagtaattcatcttcaacttacacctatctacatattttgtttctcctcattaaactggagacatcagtgacaaacttatgaagtggtagtctttggcttcataaaatacacacagatgctcatcagaggctctttcctgcttgcttcttagtgacacatgtttataattttgtctgtattgcgtttgctgtggtttactcttaagtacatctgttcaattaaaatgggaacgtgtgacatggcctgtactcagcaacttttgagcttgttaatgaaatgttctaaggttcctgccttagctctttatttgcaaaagggtttcattccacagagttccaatgattgaaaagtacaaataaaaataccctttaaaacacatagaaagaagtcgactgttttgttaatagttaagaaaggacattattactgcataaggacattattttacatgaaaagacattatcaaaaatgatttactgcctcatgtttggaaacttacaggaaaagtctgataatatattaaacttgtttattacagcttcatataattttaaataatactactttttcctttgacaagtgcaataaactctactggtatagacataggttgattatcacgagtcaactgtgtgcttaaagaaacatgcccaaacaatcagcttttgacggctgcatctcccgttatttacactcaccatcatggtaataactcaccatttctatattaataaggcagtgaaatttattatgatggcattgaaaagttattaagtactgcatcccaagtgacaaagtaccacagcactgtcactatccaaaagcagttgcccattcatcacctgcctttccagatggtcctgcatctttatcgctcccaggttggtgacatcacctgttcacccactcaaaattgatgatgaaagcaaacagatctatcttacttacatttaccaaatcaatttaatttttacaggccatggcttggtgacatattgactgttttccttaatggcatctaccgtatttaatgcaaggatgtcatctttgattcctggcttgcataatgtgtcatttcataataaatgttttctaacatatttacttaatggaaagaattatgattgcttgtcagttctcttattaaacataatgataattctttttcttcttgagtatcatccattgggcaagaaatctatttttatctctccttgtctcttacaggagataatgacttggatataaagtaagctctaggcaagtgttagacataccgctgacccttctcaatcctggggctcagtgtaagggttttatcttatttatttgttactatagaagaactatagtcttaagggatgctctaattaacacatcagcaatagctaaagacggatatgaaatagcattgcaaaaggataacagacgtaaaactgattttaacagttcatatgatgtttaatctttacttccctgggctagtatagtcgcttctcttcagctagtgactctatatcgagtgcatgttaaaatacatatctgtgttgtaaaagttaagatgcaggtacagagactagtctactgactatccgatactcacatgtgacacctcctttccccaagtatgatttatagatcccatctgctgctctttggaacaaatgcttctctgacctgtgtcaccatggcattgtggtacatttctattacctaagggaattagcaattagatttacttttggagatgaaggcaaaatggcatcaagcttctgtatttctatttaatatccatactatatgggtatgttctggggcaatattcctgactcattcctcaccagtgcttatattcagagaggtgtgggagtccagagggaaaatcagtatgtggtctccctgccctctaagcccccacctgtgcaagtaaatgtgtatgcaagtaaaaacaacatcaaataaactccaagtgacactctaaagagaaaaattgggaaagggtctgtgacaaaggaaaactgagtaatctaaggtgtgtgtttctgtttctttaggtatttatctatcaagcatctatttctttagatatcatgacctagccaagagaagccttagtaaggtaatggagagagaggactggaaaaggttaaccggcttcagctctacactgctgacttagactgacagcaattgcgttccttctcttgctctctggttctctcaaacagtgttactgtagctaatctctccccacccttcattaaggctagatgaggtctggaatgaccttcagatttatcttgccctatactgaactggttgggtcccagggttggtgacttcctggggagattccaggaagatggaagaactccacacaggatcactctccatctgtgctcctactgtttagtctcaatcacgtgagcagaaatttatatgtcaacaacagcactctaggatggcttatatccctttggaaaccaggtccaggatttcctacatccctataattgcaataatactacctcaaactaggaaaaaaaaaacttgagttcaaagccaggtaacctgctcctacccgtacagtacattcacataaggagactcatactcatctgaaaaaatgcttcatgttcatctgtgattagtttatcctaattcattagtcagagtctttcccttaggtgaggcttccaggaaaacagggattcaggccagtagtgttgcgagaccaacaagaaatacctttttttgagggcagctggcctctgtgccagggtggagattctatgctggcatcacacacctgctgaattcttaccacaagaatctaaacaacgaaaaaagaaaaaacaaatcatgcacacctgtggctgccaaccagtgaggtttcattgccatgccatgcacacctgggaagcctgtgaggtcagctgcagtgtcagaggaaaacaacactctcagccagttggtaggaggcacaaagcatccatctcccatgggtctgtgacatgaactgactggccaatagccatagaaagtacatacacacacatcttctatgaaaggaaaaccctaagtgtaggcatggcaagaataaaagagatttcagagcagaggctaactgtaatcattatctgctgcgcactgtgcccccaggaagaaggagtcttcttgcatcaactcttaggtcctcctttattagccaaatccagtcgctgggtaacccagagaatagaaaaagactatattgaataagtgtctctgtatgactgaaaaaacagaaatgcagagtgctggattatgaggagagtgagaattttgagaggagagagtctgaaagcagcacctgctggatgtgtgagatactgaaagactaagaaagtgaattgcagaaatatacagggatagtggatttaagttttgcataacattagtcatggaattcccctgtgatgtttctagaaaagatgtgatttggtttttaattttttttttgtgggggtaggcagaagttgatggaccttaaacaattttttttgtagttactgccaaggtgtaactataaggcacccagatttatatgcttacctaaagaaagcatcaggtatcaaatacagtactggtcgattccaaaatgataaatatttaaaagcaagaaggcatgtgtatttgcctgtgtgtgtcgtaggggatggtatacaagattgtgcagtgtgggttctagaaacattgtttctgtatcaggtgacattctatggctgacttcctaggattagattaagaagtatcaacaaattattttctgtatcttcagcagcactctactggtggaataaaagtcgggtctgaaagctggtggaataaatgctcaacagtgtaaaggggctggatctgcaagtagtctattggcagtgggtggcatggccaacaataatacaattaactttcaattgttcttgaagctgattgtctggttcctaggcatgtatattcctctgagaagatacctgtgagatctccttaggtcatgtggacccagctcacactatgctgtggagcacttcagtgagataagctatttctatgaaatgtttgctttaccgtccatcagtgcaagcatcttttttaaacaaaggtactgtcaaatttcttgtgctttatgaacatcttatatcgaatatcaactttaaagacgtagtttttggtgtctatttgcacacgtctctttatattattccttgttctaatgatagttgaccaattcttgccctttgtgattttttagcttgacaattctactaattaacatgcagaaaataatcttaaaaagcacacaatattttaccaatcttcagtttcggttacatcatgaaagaccaaaagaggttctagggcaaaagtgagcatagtatttatctactgaatttgcctatagctgaaataattcattttaaaaatcactaccttggacagaattatgtataaagagaagcattttatcaaaatgattgtatgattctatcaatgtaaataaactttgagatgttaagatactacattaataaaaatttttatttatcattcaaatggaagagtgtacagttcccctcctactccccattttttcatgctacctacttatcattattggaacaaattctcttcatgttgctaccttcatttgatgaaacaactagggagcaaagaagctgaaccaactcctatccttctaagatagatttgaattggttatttcctattacttctcactgcttcttaatttatcctcaaggaaaaagcatagagaatagaatattctgatgcagtggtctcaattaagtattctagaatattaagcatcataaagaatctctgtccctataattgccaaatcctagacaactgtcaaaactattaaaagaggctctttcctgaatattttattgtgagttttactattgacttagtggccaaagagggaagcaataatcatgcaagtatgggggttaataataagaaagaaactcatgagggtttgttttgggataaacaatttatatgaggtttcctaaccggaagacaaatcacccaacattcctttgaaaaacgattgattcacattcaaattctggttgatcaccaaggcagacagagcaaaacagaagactcctcatacttgaggaaattttcttaaatttggacatcagacttttccacttcaccaacttcactttggaagtactagaggttgcccaaacagcagtaagagtaatagacatgctggacttcattgacatctttcatagaagaaagaataaggcaagcaagcctcatggtatggacagagcatatgtgaatgtaggaaaggggacagctgacctttccataagaaagaaggtccctcttgagcccaggccaaaaccagagacagtccatggtgcttctggagggtaaatgtctataaacttgattgcagccttttttttttttttttttttttgagacagggtcttgctttgttgcccaggctggaatgcattaggatgaatacggctcactgcatccttgacctcctgggttcaagcaatcttcctgcctcagtctcccaagtagctgggactacacatatgtgtcaccatgccagcctaatttttaatttattttttgtaaaaatggggtctcactatgttgcccaggctggtctcaaactcctgggctcaaatgattctcccacctcagccacccaaagtgctggaattacaggcatgaaccacctcacccagccttctttttttatttcattatattctaagagaatctgtaatatttccttgggcactaatgacgttcaaactcagggtcccattaactaatcttcacttctcttggcattttctctgtttttaatttctcacaagataaaattgaatatccaaactatatttactattttaaaaacaatattgcaaagcttaataaatactttgtaatgtaggcttttatagtaatacacatttgttattatattacatttctctttcttaactacacatcaaagacaatcttttggatagctggtagtcttcctcctcattttaaaaccattaagacttcacttcttagttatctagtgttaagagtatgcaacacgtcaagtgcacttgctttctcataaataaattaaactttttccctgaaataaatgccaaaccagtcaaaattcattttgtgcccaagccaacctaaagggtcctaggggagaaatactgttattcaaagacatctagtgcaactggcataaaaacatacacatagactgatggaaccgaatagaaagccgagaaacaaagccacacatatacagccaactgatcttcaagaagggtgccaacaacacacaatggagaaagggtagtctcttcaataaatggtgctgagaaaactgaatatctaacgccaaaaaataaaatttgacccttacttatcgcacaccatacaaaaaactcaactcaaaatggattaaagacttaaacctacaacctgaaatcataaaacttacagagaaaagtataggagaaagactccatgacattggtcttggcaataattttttttaatatgaccccaaaagcataggcaataaaagcaaaaataaacatgtgggactatatctaactaaaaatttctgcaaagcaaaggaaacaatcaacaaaaacaaagaaaacctatggaatgggagaaaatatttgcaaaccatatatctggtaaggggccaatatccaaaaatatataaggaactcatgcaactcaatagcaaaaaacattaataataaaataactcaatttaaatatgggaaaaaggacctgaatagatgttttttcaaagaagacatacaatagcgatcaagtatatgaaatgatactgaatatcactagtcatcatggaaacgcaaatcaaaaaaccacaatgagatatcacctctcagctgttagaatgactgttattggcgaagatgtggagaaaaggggctctttatatactgttggtaggaatttaaactggaatagccattagggaatacagtataaacagtcctcaaaaaattgaaaatacaactcctttatgatccagcaatcacacttctgtgtatatttccaaagtaaataaaatcgccatctcaatgagatgtctgcactcacatagtcattgactgcaacattatcaacagtagccaaaatatagaaacaacctgaatgcgaaggatgaatcattttaaaatgtggtacatacacaatggaatactatttagctttttaaaaagaagaaaaccctgccatttgggacaatgtggacaaacctggaggatattatgctaagtgaaataagccaaacacaaaaagacaaatactgcatgatttcacttatatgtggaatctaaagtaaaaaatgataggaacagagagtagaatggttgttcccaagaactaggaggtaggggaaatggggagatgttggttaaagggtacaaactggcacttgtaagatgaataaattctggagacctaatatacagcattgtgtctatagttaataataatgtattgtatacatgaaatttgctaagggagtagatcttaagtattttcactacacacacacacacacacactcacacacacataactacatgaggtgatgggtatcttaattagcttgattgtggtaatcattttacaatgtatatgtatatcaaaacatcacgttgtacaccttgaatgtatacaattattatttgccaattatacctcaataaagccaaaaaataaaaaataaaacaaacacaaaaaatctgttgcatatgtctaaaatctcaaattatttcattcttcttcattatcaagcacacattatttgtcagcctcctgatgctgaccaccgttgttaggtatcttagaagtgcaatgttgctgttgttgccattttaatgaatattcctgtcttagttaacatagattgcctgtttcaatatgtaaggtgtcactgtagaatctaaaatcaaacttaaaagtgtgagaactatttatttttaaaatgacacaaggaagcacatcttcattgtaatatcacattttaggattacattgttggaacataatgtattgcccaagcattgattcaaaattagttaatgaatttctgactccagtgtaatctgtttccactattcctttccacctatttaacacagcataagagatattcactctctactcatgtcattatgttctatgtgtaaatgtatgtatgttcgaaagaagaaaactaagttcacagccaatattttaactgattaaactaatttggagcaattctggctgagatgaacacaaagccgggtctggcacatgacaggtgcatcaacaactgacttatacttgcagagttttgtaatggccaatgataataaagatcagcaaagaaaatgtgccacaaggcaatattttaaagaagcaaactttttacttttttcaatggcttatctcagagtattacaaactaagccacctaaatttttctttcacgtaaacaagaagtttgtgatctctcctgaaccctcgttttcattgttagttagaaaacggtcagtgcttccatttcaaaccaacccagagtcaaataattagaccatccagagataactgaacttctaggaaacaagaaattggaaaaagagcaataacttataaaaatcaatcgataaaatataataattggcttttgccctaataaccctatgctagatctgcattttagccaagctgcttctgctgttgtcttgttaacatttattgggttcttctgccagctctgtgctaagctcctgacacacaatgtcacattttacccttacaacaactctaattggttagatacaattattattcctacgtgacatgtaaataaactgaggggcagataattaaagtttcccaaatcactcaagcccacaggacccctgaggaggacttgagaccaggaagtctcactccagaagaagcctgtttcccactgctccgcatgcagttacaatgttactacattgtgggcacttttagaaggaaacatgagaaaaacctcatcctgaaccaacagaactctaaaaagttatttctactcagtaattttaatcaatccgtaactctaaagttcataacctgagaaaaagctttctatcactaattattttcaagtcctttagacaagcacattccaagtctttaaagatctttttgttggagagaagtcacatgcattgtgaggtggcaattgctgccaaactctaatattatttttaaagtttctcttggttggataaatactggtttgagagaaaatcatacaaatgatgtttctggtatctatagcttatttttaccagaccatatattttggtctataaattatattttcaaaagtatcttatttctctaacatataaacaaaggattttccaaagtaccttacttgggaaatatattcaattttttattcttaaataaagttcagaaagatggcccctatttataatgttatctttgacctttctcttttaaaaattttctttgaagagactaccacatttctctactcaattctgattatataacggctaatgacgtggggcagttttttcttaagtttttatttttaatttttgtagatacatagtaggcaaatatattcatgagatattttgatagaagcatgcaatgcataataatcacatcatggaaaatggggtatcatgaggcagttattattgacccattgaccaaataaaaagcagggaccattcaattggagtagtttccctagaatcacacagttagtgacagaagcaagactggattatacatgtctgaattccaggttctagatttgtccatggactacttcagctctcattccttgcctcctctttcagagtcacataatcctatattcatccatccattctttcatttatccattcattcactcatttatttattgaacaattatttgttgaatgtctgtgttatagactgaatgtgtgtgtcctcctaaaatccatatgttgaagccctaacccccattagggctatttttggaaatagggccattaggatgtaattaaggttaaataagttcacaagagagggtcaccaatccaataggattagtgtccttatattaataaggagagagagcagagagcttgttctctctctctccctctctctctctctctccacctgccccaaccctctctctgcttatgcacaccaaagaaaggctatatgaggatgagatgagaagacagctgtctgcaagcatggaggagagcgctcaccagaaaccaaagcagctggaattttgatcttgaacttctagcctccagaattgtgtgaatataaatttctattgtttaagccacccagtttatggtattctgttacagtagcccaagctgactaatacagtctgcttatttcatttaatggcactattttcagaatagtgccacagggattaaaaaaatatatggaacacaatcaaaacattgcactaggagaatacacctttgcaagctctcaagaactcttgctttgttagggaagctatgtaaataatctggatactacacaatgttttagtgttttcagcccaagaagttcaccccagaagcctgctttctactgctctgcgtgcaattctcacgttgtctcataatggctatctttagaagaaaacataagataaccctcatctttaataagtggatccacctttcttggtgggacaaaatttaggtagtaatatattgtaattagaaagaacataaggctgggcatggtggctcatacttttaatcccagcactttggggagccaaggtaagaggatcacttgaggaaaggagtttgagaccagcctgggcaacataatgagaccccatctctacaaaagatgttttttttaattagcgagtcatggtggtacacatctgtagtcctagctacttggaagactgaggctggaaaatggctttagctcagcagtgagctttgatcataccaccaaactactccagcctgggtgacatagacaaagggagaccctgtctctaaagaaaagaagaggaagaaagaaaggtcatagatgatattatggaagaagcaaacttgaggaatgaatagaaacttgctaaggatggggaggaaaacagtttcccaggtagaaagaacagtgtgtatacagctaaagcagtgtttagagggaaatttgtaacactaaatgcccgcagaagaaagtgggaaagatctaaaatcaacaccttaacatcacaattaaaagaactagagaagcaagagcaaacaaattcaaaagctagcagaagacaagaaataatctaagatcagagcacaactgaagaagatagaaatatgaaaaatccttcaaaaaaaaatcaatgaatccaggagctgttttttaaaaaaaaaattgacaaaatagatagaccactagccagactaaccaagaagagaagagagaagaatcaagtagacacaataaaaaatgataaagggcatatcaccactaatcccacagaaatacaaactaccatcagagatactataaacacctccatgcaaataaactagaaaatctacaagaaatggataaattcctggacaaatacaccctccaaaggctaaaccaggaagaagtcaaatccctgaatacaccaataacaagttctgaaattgaggcagtaattaatagtctaccaaccaaaaaaagcccaggaccagacagattcacaggtgaattctaccagaggtacaaagaggagctcgtaccattacttacaaaattattccaaacaatggaaaaagtggaactcctccctaactcattttatgaggccagcatcatcctgataccaaaacctggcagagacacaacaaaaaaagaaaatttcaggccaatatccctgatgaatgttgatgcgaaaatcctcaataaaataccggcaaattgaatccagcagcacatcagaaagcttatccactacgatcaagtcggcttcatccctgggatgcaaggctggatcaacatacacaaatcaataaacataatccatcacataaacagaaccatgaaaaaaaacacaggattatctcaatagatgcaaaaaaggccttggataaaattcaacagcccttcacgctaaaaactctcaataaactaggtattgatggaacgtatctcaaaataataagagctatttatgatacacccacagccaatatcatactgaatgggcaaaagctggaagcattccctttgaaaactggcacaagacaaggatgccctctctcaccactcctattcaacatagtattagaagttctagccagggcaatcaggcaagagaaagaaataaagagtattcaaataagaagagaggaagttgaatggtctctgtttgcagataacatgattgtatatttagaaaattccatcgtctaagcccaaaaactccttaaggtgaaaagcaacttcagcaaagtctcaggatacaacatcaatgtgcaaaaatcacaagcattcctatacaccaataatagacaaacagagagccaaatcatgagtggactcccatttacaattgctacaaagagaataaaatacctagaaatactacttaaaagggaagtgaaggacctcttcaaggagaactacaaaccactgctcaagaaaataagagaggacacaaaaaatggaaaaaaattccatgctaatggataggaagaatcaatatcatgaaattggccatactgctcaaagtaatttatagattcaatgttatcccatccagctaccattgactttcttcacagaattagaaaaaactactttaaatttcatgtggaaccaaaaagagcccatatagccaagacaatgctaagcaaaaagaacaaagctggaggtgtcacgctgcctgacttcaaactatactataaggctacagtaaccaaaacagcatggtactggtgccaaaacggataaagtagaccaatagaacagaacagacacctcagaaataacaccacacatctacaaccatctgatctttgacaaacctgataaaaacaagaaatggggaaaggattccctatttaataaacggtgttgggaaaactggcaagccatatgcagaaaactgaaactggacctcttccttataccctatacaaaaattaactcaagatggattaagatttacatgtaagacctaaaaccataaaaactctagaagaaaacctaggcaataccatccaggacataggcatgggcaaagacttcatgactaaagcaccaaaagcaatggcaacaaaagccaaaattgacaaatgggatctaattaaagagcttctgcacagcaaaagaaactatcattagagtgaacagtcaacctacagaatgggagaatatttttgcaatctatccatctgacaaagggtaatgtcccaaatctagacggaacttaaacaaatttacaaataaaaaacaaacaaccccatcaaaaagtgggcaaaggatatgaatagacacttttcaaaagaagacatttatgtggccaacaaacatatgcaaaaaagctcataatcactggtcattagagaaatgcaaatcgaaaccacaatgagataccatctcacaccagttagagtggcgatcattaaaaagtcaggaaacaacagatgctggagaggatgtggacaaataggaatgattttacactgttggtgggagtataaattagttcgaccattgtggaagacggtgtggcgattcctcaagtatctagaaccagaaataccatttcacccagcaatcccattactgagtatatacccaaaggattataaatcattctgctataaagacacatgcacatgtatgtttattgcagcactattcacaatagcaaacacttggaaccaacccaaatgcccatcaatgatagactggataaagaaaatgtggtacatatacaccatggaacactatgcagccataaaaaagaatgagttcatgtcctttgcagggacatggatgaagctgaaaaccatcattctcagcaagccaacacagaaacagaaaaacaaacagcgcatgttctcattcataagtgggagttgaacaatgagaacacatggacagagagaggggagcatcacacaccagagcctgtcagggggtggggggctaggggagggataacattatgagaaatacctaatgtagatgacgggttgatgggtgcagcaaaccaccatggcacgtgtatatctatgtaacaaacctgcatgttctgcacatgtatcctagaacttaaagtataagaccaaaaaagaaagaaaaaggaaggaaagaaggaaggaagaaggaaggaagcaaggaaggaagacaagaaagaaagaaagaaagaaagaaagaaagaaagaaagaaagaaagaaagaaagaaagaaagaaggaaagcaagcaagcaagcaagcaagaaagagagagagaaagaaagaaagaaagaaagaaagaaaagaaagaaagaaagaaagaaagaaagaaagaaagaaagaaagaaagaaagaaagaaagaaagaaagaaagtaagtaagtaagtttggggacttaatacaatatggaaaccatcaattagacatggttgatatgggagagaaatgtgtcaaaatgacacatttttttggactgaacaactagatagatggcaatggaatttattaaaacaggaaatgtataagaaggggagctttgcaggaagaaaagagcaagggccctactagagacagcaatgatttgttcagttatgataggctgagtttccattaggggaacatttaatgcagaatctgatgcatagtagtccctcaataattgtttgctgaacatggattttctctgtatttatttgggaggaggcctaagaggtttttttttctccttcatcatttttttcaaaaatgaaggcatatcaaaaagagaggtcacactagttaatcacaattatctctaactaaataggaggaaaaccagctagagttgagaaaaagatgacatggggacaaataaaagtcatccggcaggggttgggtgagatgcctttgagaaagtgcccttgctaatcatgattgggttttgtattaactaggtaagattaaaagagaaaaaaaaaaaaccctaagaagaatcaagagctcaactgctcctctgtggaaaacaagtttgccaaaattacaaaaagtcatttctttggtttttttataatacctaaagagcagacaagccacattctcaaaaggaagggtaatcgttaaaatgatgggaaaagctactgaattggccatcaactgaattcttgaaggagaaagaggagaaagggaatatgtgattttcggccaaaaagtcaggaactattttataaaggtgtcttgaattccaagcaataaaaacaactcagttttgacataatgaaaaaaatcattttacatttctcaaggtaaatatttgccagtgtatatgtggaagacatttcactccaaggagaaaaaaataattatttttgaatttcctccaaatgcagaattttccccaggttcatccaccaatccataggtattatgtttaaaacggcacagtcctgcatttaccaagcctgtaattgaaaagtgatttcattattaagctgtggtttattccaagccttctggataatcttgatgagtattgcacttgttgcttaactgtggagattttgtaataaaagtttaatgagttacttattattagaatgtttatagccattattttaaggtgaacaataatgacgtaaagttcgtacgcatttggtttaaaacgtattcaactcacatatcagttaatgctacagtgatttttaaaaactctcttatcagtacacgtgtctaaaggcaatgcagctaaacctcagctttactggggctatggttaagaatgaaactaaggaaggatttcccacttgaatcatgtcaaagccggattctggcatttcagaatttgaacaagaattgcttttattatggcattttgaacagatttcacaagaggatacatataaagcaagaggacaaaaagttgaaattaagtcctgaaggcactgaatattcatttctatttaaaagctaaccagatattctattaatgatcataaatattaaggaaacataccgaaataaatccagtttatctgatttctgtctactgaaatgctatgaaaccaaaggtcaatcacatctctaaaaaatatcttacccctgcagaaactgtctacaagtttttcagatagaaacaagattttccagaaattatgatgtaatgattcaagcacaaaagttttcaagttacagaaataaatggaaagtatatatatctactgaatctgtataaaacttacactcagaagaataacatagttacctgtctttattgaaataaatttaatttagattctttaatcagactataacttctaattcttagatgttgccaaatggattttatgaaaaatatgactgaaacgagtgactaattttcacaaccattttgtgcgtctgttttgatgcacaaattactcattaaatcatttgaatataaagaaccataacctaattcagtgatgagtacagtgctgacattctggaagcatgtataattaaagcagggttatcaaaagagaggcaaaatatattagaaaaacatagcacaaaatgaaaataaaaccaaattaactcatagtcacaaaatagagaaaacaaatgttttcctccaatcctccaactccccaccccaaaaaagataaaatgcaataaacatgtcatatgattatgcttgtttgctaatgccacatgctacacatggtcatagccaatgtttccaaacgttaactataaaatcatatcttcttcctttagtattttttcaaatcagtacaattctttaaccatatattaggttgggttccctcctatcacgctatacctttaatcaatacattgtttgtattaagaagtgagattgtaaaggaagtttattcttaaaaacctgttgaaaacatattgtaacaaatataatttgcttattttgtggatgcttaaacaatctcttctttacacagctgcaatatataaatgtgttaactcaaaatacattcttacctcccatccataactggggtctttcaggtttgacctctgctctcccacataaggcccaaacttttcacctacttcgatcttccttttggtccatattcctagtcctgccccaggcatatttgactctcgaagttcaaactcagcaggaatggggatatcatcagggatgtagatgggggctttgtaaggagaaccctcctttggagtgaatgcttcactggatgtggcaggagagcatggctcttgaatattgagggagggagtgctggctactccatctgcatctggcatttcttccaaaggtatttcagggtagttgccatatacacactcattatctgtgaataaataagaacttcatgaattccttctgatattgaagagacaaaattccacaggggtagccaccttattatgttgttctttgaaggataaacaggaaagaccattgttacgatgtgccttcattaaaatctttattatttacaggccagggagaggctagagattatggcctctgtggtttatctgtggtgaatccataaatcaaatgagctaatcctcaattgtcaatacttgcatgggctagttcaattcattatccatctgggaaacaatcagcaacttcattattggtctgactaaagtacagacaagaagttaaacatgtgtgtaactacaacccccaaacaattccaaattgggagctgacaggattctaaaatatattagaaagttttgtcatgcaatgttatcttggaataaacataggagagtcatcaaagattccaaaggctgccatgtgccacaaggcttaaatgtgtgtggcaggattatttattggaatattagtgttttttctttctctatatttcctttccaattttgaacatgtcaccaagcccttggtatttccttgcctcagtaacttatgcagagaagaaagttaaagttacctgaagccagtgatgcctctgggtattcgtaaacgctaaaatcgttaaagaaattgggtaaattttccagcggggaaagggagaggaagggtcccttgagatgcaccaaaaagacagagaatttcctccagacagagaaatgagggagatcagaaacgctttgtatggggcactgctcatctttacggagcagcacctggggaggtggcaagacctttgaacagacagcagggttggatagctaggagttacgacactgagcacggaggacctgaggacccccaaggcagcacggcgccacacttgaagtaaacgagtggaccgtgggagaccttaagacctctatgaaacttgtatggggattttatgaaaccaatcaaaggggatttcagttgtcttagagcaaatgaatacatttcttgtctgctaggatcacaaattgaaagtcatacctgatttgtttgattcatagaacttcaaggaaggaactaagaaaaacagatgaaaattacgaagaaacagacttcgatcgagctagtcaaaggttaattatttgaaaaattagctgagtgtggtggtatgcgcctgtagtcccagccacttgagaggctgaggtgggaggattgcttgaacttgagaaggctacaatgagctatgattgtgtcactgctgcacaccagcctggcaagagactgaaagcccatctcaaaaaaaaaaaaaaataaaaaaaataaaaaaagaaggtaaaatgggttgcctccagctccatgatcagtgttctactatagcctggataaccacgagttaaggatgatgcatcatccctaactcgtgcatcaagttgctgattaaactaggtgactttaagaccctaccaaccccgcagttctatcaattaaagtcttctaagagagtttattgggctagaagatagaagaccttcattattcagatttattattgtaacagactataacactcatcatcaattgcccatcaagtaatgactcctgtctcttaaagttttgtgaagtgtaaagtgatagcacatgcaaaagtattgtttaatgaggtgcttggttcttggttcaaacactgagataatgccatttaaaccaagcatataactgaattccagaacccaaccttatacctatgggacataggttctcaacatacaagctcattatcattcaagttcagcatgtccaaaatattgtaccttatcatctgccctcaaattgattctcttgttcactttcctctttctactatgaataccatctctcccttaattatccatgtctgaggctttaaaataacatagccattttctctcctttgtcttccaaactgttcagtcactaaatgctatttgttcttcttgcaagattctaaccttcatccaattctttcaaatccacattttcacacctaaatattttcatagtcctttaaatgggtctcaacctccagcttctttccactatccatcaacactgagcctgtttaacactgctgagtttaccttcctggcagaccaattttcctgtttgacagccttcaataatctccagtgtctgcaggtaaagtataaacctcttaggtttggactaaaatctctgtggttttgaaaccattcttcctttccatctgattctcaatgctcctcaaagggaacccccaagttagagtaaacttactactctcctctgagctcagtgagtatttcttcttcagttcttcctgcctggcactcctctctctgcacctctgcccgacaaacttctagtcttcctcctgagtcaaattccagctggtcctatcaccgtcccatttaacactagtattctcttccttgaattattacacaattttatccctcagtttggcaatcatataccatgcattgctgcttatggtttaatgtgtatgattgtttcattcccaagtaggaaataggtccctgatgggagacgctaggactcttactttttcagaattgtccaagtgatctgcatataggtgtttaacaaacacttgttaaatatataattaatctaacatataattttattaaactatgaatccaaatcaatacttttttttaccaaatataggaaacttttgatcctacaaagcacctttaaacctgtagaaatagaacatgatgaattgtccacttttctccaaacccaacatcaaaggaaacaattttaataattctccaaagaaatattatcagagaagtatactttaaggtccaaacatactcaacaaaatccatctaattttatcgttcagggagattttgcaattcaacctaacatttaaaagctcattaatggtcttagcacaggtaaaaacctataaaaacatctctttagaactgtaacattcaactactgcaaatgcaaagttattttacacattcttaaagcgatttctcccccattgttagaattctgtttttcttgagaaatataaattgtaaaacattgtgtactctataaatgtgtccatgtaagcgggaggaaaccaaaaggcaccaaaataaatagaacaatattcctcccgtaattatctattaaagatcagtaaaatttcccctacttcctcaaagtgtcaaatcagtcatactttcagtttcatgaaagtgatctttaaaaaaggatagaggccgggtgtggtggctccagcctgtaaccctagcactttgggaggctgaggcaggtggattgcctgagctcaagcgttcgagaccagcctgggcaacatgacgaaaccccatctctactaaaaatacaaaaaattagccgggcatagtggtgcatgcctgtagtcccagccattctggaggctgaggcacaagaattgcttgagcccgggagacagaggttgcagtgagccgagatcacactattgcactccagcctgggcaacagagtaagaccctgtctcaaaaaaaaaaaaaaaaaaaagcatagagacaagcccatctgtgccctcccactggcatagcttatcccatgacctctgaattacccacaaactctcccaatgcataatctaagcgagtgcatttagatttcagttcctgtggagacaaaatacatgtgtgtgcccaggcagctgcacagaagaatttgaatttaaagcctgaatgcaattctgcttacaatgacaaaaatgtacaattaaacctaaagaacaacttacataggtcaagcaaatccacaagaagaactcacggacctattcatccatatgcaagcactaaatatatatgcaagtgcaggcaatttgttttgaagccacttttaatctagtatcatccaaattaaatgtaaaaaaggctgtgatgacaaaagcgaaaatattaaactgctgagttttacgtatcaaaacatgcaacaatatttcaatgtaatctagcattatgaaattttcaacagcaaatgcagtttatcacaccacattgaatatttgcataaaccaaaataaaataatgcctccatatacattactcaaaaactatccaaaaagctgctaaaacatttcatctaaatgataaattacttcaattatcatatccccattaaatctctgttattggggaaaattggtagatcctttccctcagctataactatagttaattaaagcatttctcagatatcacactgacagattgggcacgtttacaataggtaagtatcaggtaagaagtgccatatatatcagtggtcccataaagataaataacacttgtaacttcttggagctgagctgtctgctactgtaatttgcttcatgcatcctttaggcatgtcattaactgagtgaggaaagaaagacaagcatattgttggatttgagacaaatgatttgggaaattgctcttggaagtcaacctcttcaattcaaattttaagtgttctaatttcctcagagaccaagggaaaggccacattttgattagattatatttatttatatgtgtctttgaataactaccataggtttccacttcagaagtattccattttggaaacatatcagaaccttcaaagagaagaaattgcagaaataataccaataatagtaacttccatagatgtatccacattttctcattttaatgctcaaaacaatccattgagaaaatgatgataagaataatcttccattttccagatgtaggacctgatattcaatatatccaaagtcagctgagactagctgggtgtccaaacccagtcctccctttaactcttaggcaacttgtttttcgatccttaaagatatgttttaaagtttgtttgttttatcaaaatcgtagccataatgtgtgaatactttggcttttgactttttcattggattatagtttattataaacccttccttatgtgtattttactattttctaaaactacatttaattgctttataatattccattataggaatccacaacagctgaactacttccatggattttatttatgttgcttctaattttctgatatcataaatatcatgaaaatgagccttccttaacataaatttttattgtcatccatttcaatttccttaggttagattcctataagaaaacttagtgggtattgacagattgcttttcagaaagtgtatagcaatttacacttctaccaattatactggcatttattattatgtcttgtttttaataaagaaaattatatatctattactgcttaattcacatctcagttgattacagaaactaaatattcttatttgtcattcaaacttctttatttgcaaattgttcattgtttttgcccacttttaattaggctttcatgtctgtcttattaatgataaataaattagcccttggatattgtattttaaaatttcctagtagacaatttgccatttggtatttcgattttttttaacttttatggaactaagtctatatgtcttttgtgatttttacatttttcttacaaagtccttacctacagaagggaaaaaaagattcccttgaattttctttgagtttcatagttgcttttctaccaaccttggattaccaatgagtgatttactgctgagtgaaaagcagaaaaaaaaatgatttcatttatttgagcgcctgtgaacggcaggctagaaaaaaatgccatttcactcgtaattcttcggttcttatttgcaaggctggcctaaatgccttctctttttgtgggttttatataactcaccatttgtttcttttggcctttccgcctagtttaactgcaaatctggtcagatgccattcaaaatcctgagtttcaccattaatgcccatcataatacttatcactcagcattatcattagtgatagtaacatgaataatttttctctctactcttcacattagttcattgatagaaaatattcagcaactaaaaagtttaatattaagagcatatatacatactttgactataaagtaagactgatttctgtagttattaagaagttaattatttatactcaactgtacacatatatgcatataatacacacatccatgtgtatttgcaatctgtgtgtaggggtgtgtgtgtgtaatagctccctaatcttaaaaataggctgagacagaaacatgatttgagatcccaggcagactggttgagatcataactacatgaaacaactgccaagaggagctcaactagggaattgaacagattaggtaactcagaaatttagacatttccccccattatgttcctcattgcagttttgtaataaaaacatgagcaaacttcaaaggaagctctgtagtaaaggttaattgctactaaagaagagggtgggcccaagcgccagtactttgtgcccaacttgcaagcagacaggaaggattacacgtggctgagagcggaggatgtgtgccctgctctaggaggagaacagctcggccaaacctcaaagccccactagggacctcctggtaggacgtgagcacatgagcacaagtccatgagctgatgcctgctaacagtgcggcagggaagggagggggaagacatcaatttccttacaaaattaaaactggacatgctcttcttcccttgttaggacaattccagagcagttacagaggcttgtttgtgagaaagcagaggacttcgggagccagctcttctgcaccagtaacacagtgaataaacacgtgctgggcttggggaaaagggtggagctcaactaatgccagatgcacaaacagaacaaagaaggaggctatgaactggccagcaaaatcttctatgagaatggccccaagataatgaaatttaagatcccaaagaaacgaagaaaggaaactagtaaaagtagggaaaatgaatttccagaaaactgacttaaacaagctgtgaaggactgtagcaagggtgcagaattacaggcttagaaaacagagacattgaatagaatgggaactgctgatgggcatagtctttagcatgtcctgctccagaggggagtgagaagaaaagagacttaaatggagtgtttggacactggactgaatctgtagaacccgtgtctctagatacgaccattatgtttggaaataatctatcaacatggcttggcactagaatttttttaatgaccctctaagcttccttgcacttttagtatttgctacttcatagtaccatgctattccatgtcttccttatggaacttttccccagtgtttcctaaaaatatttcatatacgagttgtcaaaaagactcagaatggaagtattgggggcaagatagcaagggagatggcaaagaatgtgatacggatggaaaataagggactaaatcaatgagcaaacttttatttttctcctggtattgcggcatactgttgcatgtcctgtggcttttaaatctggttaagagattttccactcctctaggaatttcacagacatttcactaaataaatatgatttgggaattaaactagtactcctaagctattaaaaaatgggcttcgcctcttccaaaactttctcttcagagatggaactaagcttttgtcaaaaggtaatggaaagaaattgctagaaaattcatacttgaggtaccagtaaagccatttggtatctagttactgaatctaaaagagctaacgcaaagacattaaagttctgtgagtactattccaaaggaaaacatgagctggttaatgtttggcttattctgttgttaaggagccaccgtcaccaatatccactggaatgaccaggtaagaacagacttatcacatatcagatagatagtttttcttttatgttttagctatgtgcctctactttcttttgccagtacaaatttttgagagacttttagcaacctctgatggacctgatgggctttttcttcataagctttctatgtccccaaagtgattttccttcagattcatttagaggaaagtagaaccgtcctgaattcatgctgcagcagactgggtggttactcctcaggcaatctgaaatgaccagagtacagcctttcagtattccagccatatctacagtaattatttgccagcatatctaaaagaaggcaggcatttcctgttgcacacaaatgggacattcttatctaaattactgtttaaacaggtatttaagaaaagactatcacagtcaggaatttactgatgacggaacacattagtttagggctggacacattagttgaggactaaccattgtcaagaaaggaagtatatcagcatcaggaaggtatagagaatattttacaactcccatatgggtcaagatggaggattgtaaactatgccatttgcatttggagaaagcaggagggtcacaagtcctggcatggagttgtgcttgcgtcaatatgttgctgaaccctggagtaaccttgagaggcagaggctgagagtcatagctgcttggggtctctgtttccctatccataaaataagcatgttggacaagttcatccccaggtccattccactcaagcaatcccagttctacatagtagaaaccagaaggtggtcaaaatttggtgtgccaaaagcttataaaatgtatttcctggaaagacactctgagaattggtttggtctctcccaacatgtaacctaggagagactgtgctctagctgcctaaccttgctctaaccagtgaaactggaatttattcccagtagaggcttataaaactgggctgttattctcacattaagtagactgccctctggtgaggactgtggtttatgtgtgggcagaaggtgtggtttactacctctaatttgtttatgttgttgatggtggtttcagaagaaagctgcaccccttcacatgctaaagagtgaccggatttacttcctttaaaaaaaaagtgtttaaaggtgggcagagacatgagggagcattaatgtgccattgctaatggaggagcaactgggatccctgtgaccacagctctgcttcattcagctctgcatgtgaaatgagagccccaacttgtttattataattacctaagtgtggcttggtggcttttggcagagatccttcttgcctccaaaggagagaccaaaactcaggagctacacgctaaaggaaggaggatggtgtgcattctgtagcaaggaggctataattctaatatattctgggtgaaaatattcaaaacaacccccaaaagatgaagatcaaaaagtaaatgagattgagatctaccttctaccacatggcaaacaaagataggcatgcaggagaactggataaacagcgtaaatgtaagttcaaattcattttcacagctgacttgatgcagacccttccctattaccacaaaacagaagagctttcttacagccaggagtcttacataaagaaaagaaaataattatgcatgtctggcagaagagggagttgtagcaatggcttgctggtaaaacggaatatgagcgagcaatagaacactaacttaaccacactcttggtttgataagaagcagagagtgcccaaaagattgaaattttgttagagtctcaaaatgttttatttgaaaatgagcaatggtccttgttctcacaaggtttggtaactaaaagacagcaataatttctcatcttaaagagattctgtggaaaagagtccttgatttagctaattttagcttgaactctaccccattgcaagcacagtatcttcagtgttaaacaagtttagatgttgctaaggagtgcaattttctgcccccattctaagctctaaaggcccccatattgagtttcccaataccacatcatattaaatgtaaaatcattcaaaaccacagagatgaagagaatgtcattgaaaaacataaaggaagattttttgctttttttaagtatgagaaaacattatatattttgattaaaaatgtttgcagaaaaatatgaacagatgtgctatgcatatgtgtatacatacaccaaatagcacttataatttgagagggggtaatttcaacattgctaagtggtaacacaagctaggtatttaagggaatgatataatatgacaacttcatagactaccaaactatgtatggtctctggaaattgtcattatcaacatgtacaataactagtagcattaggtggtctgtacagtatccttcatgtctaattgagtcacacagtctaagacacttgatgggcaccaggcactgccttctaatgggaactgactttcaaaaaaaaatgcattcagggcctcttctatataaattactatcgtttgcagcaagagagaattataaatgtttgctggcaaaaactaaatttatttacaaactgagtctaatttatttatggctgcagtacaatcggcttttgttgaaatatttatgttatctgtacttctgcctcactaaactctaccacaatcataaacactgttgaaaaattatttgcagttagcaggatttaagctacccattatatcaccagctagtgccagtaaacttttgcactggttgataaagtttcctccgtggaataaatatacatttgactttcaaaatctttggtaggctccatactatgaaaagtgaaggattaaacagatgtcccagacttcactagttttgtgtgaatgcttcaattgcacattccaattgaaattttgtggatagactagaaaagtgcacagatttaaatccttttctagcattaaaagaggaattcgatgattgaagtgttgaggtgataatctttgccaaagatgctactgctcagacttgaattcatttacccattccaaaacatttattcaataaataccacgttgtgcctggagctgtgtaagttgctaaggatagaaatagagttgaataagataaaatgtctgccctcaagtagcttaaagttcagtagtgaagacatagatggtaacgtatgtgacaatgaaataaaataaggcctaagatgaggttaggaaaagtgctgagtgctaaaagagttgagtataagtaattctgcaattgggcatgccagtctcgtagaacctctatccttaagtttgctagaactatatatgtactacatctttaaagaaacctcttattttgattattggtggaaacgcagttgccattcacatttatttctgagtatcactaagctcttcatagtaacgtgagcatcagaatattttggggggattatctaccctcactgatgcttccaaataactcataaaatgatgaaacattgccacatgttctaaaatggcacgcccacatttccattacaaagtaagccaacagaaaacagcacagagtagtgggtagttcccatgtcaactaaatatgtatttctgcttgatctgcttcactgaaaagggcccagaagttctattgtgaataggtaggactgctgtgataccagtgaaactcccaccagcctacaaatgatccaaaccacaatatttaccttccagctagaattgaaagttattccaaactgaccagagatagtcctgatggatctcagaacagtgatgtattcaaacgaggactggccagagcaccctggaacctccagtggcatggcaccaatctggagtaggagttcttagagaagtgtcagtactattgtcttctggtgtcttacactacccaccagataatgaatttttctcaaataatttctacctatgtatacaataatcaaagtaacttaacaaaaagccaaagtagcaaaattcattttgagagctgtatttatttgatgggggaaaaaagatctcaaaaaaggagcttttcattcatcaaggtgctttgtaaaaaagaatacccaaaactcacatatttggagcttcatatttagtaatataatcataaaatattttgctgtccacttatatcaacatgatataaaacaactcttacttagatccaggtgttattcactagaataaacaatatctcagtgatttttttggtgttttgctgatttttttatgagtttattctggtaaaccttctttaactgcttgttctaacagactatagctatgctaattaagttacataaaatcttctggcatcatattgcttaaacctcaggataatcaattgaaatagatatttcaatagcattgtagaatctcagagctaaagaaagcaagaaaattttcaatttattcatctaaacacctaaaattcttactaacttaaatatattgtggataaagccatgtaaatctatacgaaccatgactgctcatgagaaaaaattataactgttataattctatcaaaagcacataatgttaagaaaatctactggagacaggaaagatacctgaagtctatagaatacacaataatttaacaggcttttgctattgttgctttgttgttttgttgctgttgttgtattaatacgtctacttcattcaagtttttaatactcatcaccactattaaatcttaacaactatgatccaacatatgccacaaaacattaatcatttagccaacaagacttctacatgtaaatcaccatgagggggtcacaaaaaagaataaagtgaaattgctgatttcaaaggacttacaatcttgttggggagataaggcaaatgcccaggaggatttaacttatgtaatataaggctgcattaaatagagtcaagtgaatggcacagaaaatgacctcaatgatcaactctaaaagtgatattccatttttttaagagaaagctgaagtgaatgctggctagaaattctagttgtgatgaaggcagataatcaagaggattgtgaaacaaaggggtatagactgtggccaagccttggagaggtaatgactttaaattggattgagtttatcatatttgcagaggtacggcagacacagaagaaaggattagagtgatttccactttctattatttgacataatgagaaaacagagggtggtccacatctctggtacatattatgagccataggagatgcttaacatgtcaggttttggtagcattgaactcttctaaataaacatatttatttggacatagttaagtcaaaacaagtcacctggaaaaaaggttacaggtcattaatttgcatagtacaaaggatttatgaatttttaaattaaccctcctggatctcgacaccatttcaaagagtagggcatatctgcatttttcttcaaagtttagatagcttaaagggtcaaatgaaaatgcttggctgatgaaaaaccagctgagccaatttgcttttttctagatggaaaagaagtgtattataaattcttccaagaaacagcattatatacatcaggtcaaatatatatacaaaacaaatgagcaaataaacaactgcaacaaagttgcataaatatttggtgagtcacaaaaagatcatgcacactccaaattcaagagagcccaagtatgaaagatgattaaagcacacctccactgaaactccactagactataaggggatgagggcagggagcatgggtgcctgtttcactgccgaatccccaggatccagcaatgtttctagttcattacaatgattcaatgtgattgtgttgagttgaaaacatcagccaaagcacaccaattttactgaaattggctggtacctttttctccttctctaaattgggaagttctaacataaatgttcaaaaggcattacacaaattgtgtccttagtctgcttaaaggtacggtaaaaatgccccactgaagaaagggaaagtgactactaaatttacacacactcatatgtgcacacataaacacacactccaaatgctcaagatactgatagattaacaaccaaacacagtcaattcagagtttatatcatgtcctcttcacattgcaaccttttcaaacaaatttgtttttcttttaaaagaaaaaaggaataaaaaacaaacaaaaagtctctacatggataatccatatttatgtccttttctcaagacttttactaagttcttcaggaagaagaacagtaaaccagtgtcaaatattaccaactaaatttgtttccaccaacatttgcagcagcacctgccatgaactagccataccttatagattgtaaaacataagcttcatgaggatagggaccctgtgtgttttcttcactggtgcctttgcagcaccaagcatagtgtctggtacatagcaaaggttcaataaacaaataaatataaaatttgttaaataaataaatataaaaatggaagaatacagaaatgagccttaaggagtccagaaactatagaagctatccccaaaccaggctgtgcctctgaattccatatgaagcttattttaaaaagtactaattatatggcatttctagaattagtgataaagaattcttactgacctgatagaatcatttttcataacatctgcagcttcctgttctatagtatgaatttacaatatcacaagaaattcaaataatctataaaccatagatccaagccaattcctgtttaaaccagaagaacacaatgggttcaagtccaccaaactagttatataaccccagaaaattctcttaatgtatttgagcctcagtttctttattcatatttgatgctgtcatatatggtacccaggagtcacatatgacaatagagcacatgacttgtggctatttccaattgggatgtgctgtaatttttaaaaatataaatcagatttcaaacacttgatacaacaagtaaaatatcctgttgataatttttgtctattgattacatgctgaaataatataattttggatacactatgttaaataaaacatattagtaaaattaattttacctgttttgttttacctgctttaatgtgactactagaaaatttaaaattactatgtggctcacatttgtatttccataagacaacactggttttcaaaatatgacaccaagttatattaagaattagaatagcaaggcatggtggctcacgcctgtaatcccagcactttgggaggcccaggtgggtggatcacttgaggtctggagttcgagaccagtgtgacaaacctggtgaagactgtcactactaaaaaaaatacaaaaactagctgggtgtggtggtgcatgcctgtaatctcagctactcaggaggctgaggtaggagaattgcatgaacccaggaggcgcatgttgcagtgagcagagatcaaggcactgcactccagcctgggtgacagagtgagacttcatctcaaaaaaaaataaataaataagaatcagaataaatgatgctcttgagcatcttttgtaagctttagagtaatatacaaatgccaaaagttattaagtgacagatctaaaatgtcattgtctttcaggtctacctgcactcagctagcaaaagattatgaaatggttcatgatcaattcattctccaccactcccctattaataaatctctcaataaacacttgttgaaaccaaatgtagaacaagatcaacatagtcattgacatggtacaaaaagatgagctaattccgcaacactcccctgccatagtttctgtgacgatgcaggaaacagcttgggctaaacaacgttggaggaaggtttacatttgtaagaggcattattggccaatgaacaatgagcaatatttaatgatagacgatgaaaacctattccattatttcagcccaaagtgcaggatatgagggaagtcataagattaacctatctctttccctatatcttggataaggcagttcaattcctcccacaaatatcccattccatcacttcaaaaacaatgtgtgctttgaaacacctggcaaagaaaagaacatgaagaactttcttgatgctcttccattgctatggtgcagttggtgaacctccaaaaaccttagctgacgaatgaacatgagacagatattcccagagtgtgtatacatgacacgaccttgataacattctcaagagttttaaattcagttaggttcagagataggcaaaccccacccagcattctcccaaagttctattatatgaaagtgaggagtagaaaggattcctctgtgggtaaaaaggttgaattgtcatgggcagctcattctgagcttttaccaggtcatgcctctagacattttatgaatattaattgatgtattactgcaatgtaaggcagttgctaacctaacattccagcctttgttccaagccttgtatcattttcttctgggctgttgattttggagtggctgtgtaatcctagtgaactgctagcaaagagtgatcaatcaacactttgaaagcttctggttcatcccaatacctgggatgagctttgataaatgatattcttgggactgtgtgaaatttacattgtagaagtagttaaatacatgtggaaacatggcaggctattgtttttgttatttatttatatttaaacaaaatcttttgtttgcaacaaatcctcacttggtccaagattattctgctgcaaactcaagtcactacatttctatatgcacgaacattagtgctctctctatggatttaaagattgccactcatttatacacatttgggggcacataaataataatataaatagaaaaatgttctacatcccattttaaaaacctggataaagggattgaagaacatatcatacacttgttcatggatgagtactaaatttatctcccaataatactttatcctgggtcatcaagattgacattcattttagaaaaatgtaggagggttagagttcttcaaccttcttcacaaaaatcagccacatctttttgaggacctcacaaagttcttttgtgactggtcacagtcaatgtgcccatctattttgtgtccatatatatcctctggaatgcggcttccctgtgttgttttctttgtcagccttctgatcttctccattctctgctcctggtgagggcctcctactgttctgagagctgtagagagagcagtgagcaagaccaacaatactcctgctcctgtgaaccttactgcttgatgggtagaggaggaaactaaaccaacacacacatagagaacatcagaaagtcttaggtgctcagcagaaaaagcagggtgaaatgtatgtgcgggtggctacttcaggtatggaaggccttgctaaagaggcagcattgaggatttacacattgaaaccctttcagatcccatttaggtgtcatctcatctgttaagggttcccactctccatgttcatcatctcctcaagctccagagtgagttccttgctttatggatcacaaagtacataaaacgtacctcaaaacatatccttttgtcaattgcctgttgctattagagtgagttttatttatgtccatctcctcgttttgatttccagtgactttagggcaagggctgtgtttcatttacctttatatcttccctcagtggctgtaaatacactagatgctcaaattcaaattgaaccaacttttacgcacatgtaccctagaactgaaagtgtaatacaaaaatgttaattatgaggagtttcgtttttgaaagctgtactttgtacctcacttagctctgaatctgacagatttcaaaggaagctctcatttacaaaagtcattgccaccacgggaagaggtattttctagaattgtagactactgaccattcagaatgcttgcccaagtaagtgacgtgtcaacttttcttctagaagaagttaaagttggaaaacaatgatctcttccaatactttttagataattaccccttggtccaaaaacagaattctcaagcttgctgcttgcaaatgtgccccagaagtgagaattttgtagttgaaaaagaatcagaaagagaagcttttgataaataaaccagagtactgagctaaaccttgtacaacacaagctagatttcaaagtagatggtgagaatgagcctagagtttgaaaattctgccagaaagttttgttttatgtttttgtggagttttttaaagaaacattttgcttttttgttttggacttgaagattgtgctcaatacagtttttcttcctttaagtgacacctattaaaagagaaaagtaaattgttcaaatagaagaattaataagacaaataaatgcccttttctgaagaatctaaattttcttacttgggatctgattatgaaattccaattataaataaactcccaaccccttacccaaaaaaggaatgtctccaagtttagactgaggtaggataaatactcaacattctattccaaataccaagaacaaggtaggtattttccctgctgcttccttaccctgaaatttgacgttcattttaatgatgcttactttattacttgtcagaaaagtgaaatggcctgtcaattttatggagtttctcctacctttcaaatgattatattacattttgaaataagtgtatagctcccacctcctttttttaacctaaatggttcatgtgtgggtttggtacttggctacgagtggaatgaaatcataatttcaggagtccaaaagaatagatcaaaatcatgccaacactttcatggatggatatatgctgctaaatggatgtttacctagaaaagtcatcatctggcatgcaacagagtgaatgtttctaagcagctaactcatgtatactaaacaaatttggcttggctgctgtgagagctgccctttggaaattctcaacatacatttgtttgattgagccgtcattcccagttgatctgctgatgatctgtgtcactttgtttaaatgtcctggtgtggttttctatatatatacagtgaaaagccagtatgtttctgtgatggattaaatagaggtgaaattcgagagtgactcctgtttttgattcctgcattctcagacaggtgggtctggaatgatcaagaatgtcacattcaaacacaggggaaaatatggagcccttttgatttaaaacacattaccgtaaagatatatttgctactgtgttctcctagtaccagaagctatttaggatttcccacctaaacaaacaccatatgggttaattctcagcatccttttcagatatccagaaacaggggacacaaaactcactgcttggaaatgcaatctaagagaagcaaacaaggctcattgctgatgtatggattcagaaatcaaatgcaaggtcaggctagaactgaagctccagatctcaaatatcccagtaatggttcagatggaaacccaacaccacagtgccataccctgtctgaggcactaatcaagcgactgcctgtttgctccgtggttaaagcacttcctgcagctaatcttcctagataggctctcagctttaataacctatggggtctgctgttaagtgccgggatctgggcaccatcagcgttgatgtctccactctgccaaaccccagacagcacgtgatgctcacgtaatccctccccttagcttccatggatgcagtagacaagggcctgccttaagctaggttcccctactcaaaaaacatacagccctgatcaacctgctgtcatacctgaaattctcccacccccacccctgacccacttagcattgtttctctgggctaaggtaaaatcatctccaagagttctgaccattaatcgtttattcatttccatttacatttaaaaacctactatggactacacagacactgaatgtggactttggaaaccaaaatacctggcctcattcttggcttcacagagcaacatttcagtagagaaggaagacatgcaaacaaaacatagtacccacgatcaacgaactatgtccaaggttcagtggagagagggaattaattctgtcttagggtagaaatggctagggaaggctgtcaagaagtggccacacccaagaagggaagaataagctgaagaagaaaggtggctttgaaggtgtttcccagagaaaagatgagggaaaaaaagaccctactagaaagaagagaggacatatctaaaggtatgaaaagtatgaaagagcttagcatgtgcatgagactaagcattcctcagtattgtctgacttatagtgagaaatagagtaggtgcacatgcagagaaagaggcagtgaggatccaaacaatcaaaggattcatgccataccctagagcttggccttcctcctattgtcaatatggaaaatggaaagatcagaactggatattagcatgatcactctgattcaaaaaagaggagaaatttaaaattggcagaaagcagatggaccagtcagaggctgtttcagtagtccatgacagaaatcatgagagcttaaaaaaggggctgtgatgctggaggatgaagaataacagggagagatttaggaagtaaagagagtccaataagggagtggaacggggataaaataaacttcaatgagctcatatactatgtcatgagttaatttatcagtgataggtaaagttggccactcccaggaactgggacacatatgggggctgaggacacagatagagagaagattggaatactgaacaacgaagtgattagaatactgaacaatgaatcaggagccctgagcccctgggaggcaatcatagagccctgggccatctagacagtaatgaggctgcagaaccaacaggcttttcccttgcttgaaggaaacctggagatcagaagatcagcatggggatggtaggaaaaaaatttcattcttacatgtacaaatagaaaaaataacacaaaaattagctgggcatgatggcgcatgcctataatcccagctactcaggaagctgaggcaggagaatcgcttgaaccctggagacagaggttgcagtgagccaagattgcaccattgcactccagcctgggcaacagaatgagactctgtctcaaaaaaaaaagaaaaccaggtaagacattagaggacaccttcactagatcgtgcagactcttaaggaatgttgattccctaacaaacttcatgcttgacattagtagctgtgcctttatattgatcacccttatgttcctacactttacgatgttcaatattctttggcaatcctaactcaggtactgccttcacaaagtgtttgccaggtacacacccctttccttgctcagtgttgcctgaagtggtattcctcaggaaaggctccaaaaccactcctgacctcagcagttttgataggcacttattaagcaaaattcaacttacatgttatttattcctactgttgagaactttgagagaaaaaaagtggcttaatgtcaagaaaagtaatttgttaagatgatttttaaaactcattcagtgcatatgcaggaaatcctgcaaaatcaacattctctatacagcgttcttccctgcttatcctcccatcccagaactctaaatccccagagcacagtactgggtggctccccagcccacaggtccctcagcctatgtgccttcttccccaaaggagatctgatccttccccaaattaatgttttgtattatttacttgtgtattttcttgatggaaaaaatatagaaaagggaaaacagacagagggtagaagttgggttttatttattatggtttaacattatttatgattattgtaatttaggtccaacatcccaagagtctcattgtaatgggtgcaatagacaccaataaaatagtgtcacagagcacatacatatattcttctacttcctttttttacaagacgtattttctctatgcacacaaagcaaatcctgtcaaattgcaatatacttctaggcattctgttttggattttcattttaagaaatataaaaggaagaatgaactgcaagacacttatttattttatggacttatttgcaccatcgaaaagagaatgacgataaatcccttttagggagggcttgtgtttaccacttcatagccattgaaagtaaataaaataatatggaataaaataaaaacaagatggcaggggctctatattaataagcccaagtgattaaaacacagatcaaacaataagcttcttttctattttgggttttgaaatttagtaattctattaaccctctgaaacataaaaagacaaattttaagtatattttcttaactgatgaacataataaaatttagatttataagtttggttattagtgtacatgcacttagttctaactcagtccctggtttcctgagaaaacccaaaatggaagatagataaaaatttacatatttggctgccaaatatttttgcttgggaactgagagaccaaatcagtcattgttgagcaacccagtctcacagaggactctctggcagtctggctctgagatcatattgcgataaatgcttttctatagaactagaccctatactaattcaagagttttaaaatttttttaaatagctaagagccaaatttcttcctagattaaaaaaaatagtttgaaaaaagttgctaaggatataagaaatatataaactggagtttttattggttgtctctctgcaaaatatgcacacacacacacaccaccacacaagtcttgcctaatttgaaatgacaaaggccaatctttcccacaatggaaatgcacagagggagaaggccaaacaacaaaacaatccagagagttaaaaaaaaatttttaaggcttaccaacaaacaaaaaacaagctcaaaataaattagaaataaactccaaacaaacccagccaaacataaagcagagaaaatccaaagcaaacaatccaaaaatctttaaaagtatagtacagtgatcccacactgttgcctatggggattgctggagggggaagccccccaagctcaggctgatccgatgggccagttcctctgaagcctcctccacccctcccactgccaggcttcctggagtcctgccctgcagaccagagagcgccacgcagagaaggctctggccaccccgccggcctggtatttggctccccagtcacccagcgcacaagtatgatggatgatgatggatcgcagcaccaccaaaaccgtgtgaatttcccaaggcctctgattattctaatcgagcccccagaagaagcacagagcttcacaaaagcctccaaggaaacctcccattccccttgtctgcctgacacagactccactaaataaagcaatcaggccctgatatggcctcctctctttgacacacagatccaggcctccatattcattgttccatgatatgatttagccttgaatgaatttttaataaacacctacagttatagcacagcgaaatggccactctggcttctcccaggggaagataacagtttatgaacacttgccagtcacagctttgctaatgttctatcgctgtgctagacaatatggtcaaaagggttttttctctatcatctagtctctttctctgtctctctctctctctctgtctctcctcaccactgcctgctctctctttccctccctccttctctctctctctctcattagatctttcttaaaccacaaagagtctctgagagatacaactgcataagataaaggcacaattatagaatttgttcaaaacagataaagagtatcacagccagactcagatatgcataatggaattttatatgttgtaataatccaagctaaaaaaaagaagagtgtagtactatttcaattgagttcagtgtcctcgacttactgagatgtttttttgccatgtaaatttgcagcttgtgcgatggggagactctcaaggctttgtgactgctgttggcttcttggaatgttccagatcaatacagacagagttaatagtaccatacaagtctataaaactccacaaactagccatatttagaaatacagctagtgtacttgcagcaaacaatatgtccatttagtactttctaatacttactgtcatccaatttctaatacttaggtacttaactgttccccttcccctaaatgtactacctcttgaactcttaaaatctctcagtatctattcacatgcaagcatatgagaaaaagggtggttgtacttctcaggagtggcccccaaatttctacatcagagtagcatatggaaatgaatttaattgaacaagggtaaggagaaggggttgaagctgggtttacagagcactttgcataagaatgagaaaatgccaacagacttcatcaaataattggaagaggagtgtggagaatgttgaagattatgggttagcttgggaagactttcctagccatggttaggtaacaccacccatacttctacactataattttgtttagccattaatgatatctcatacatacactttgattttttccccaattagccatgtagctttaaaaaccataacattttgaaatagttcatcctgaccaacaactcaggatattcaaccataatctttgtttcctaaaccagaagggtagataaataagaacaatagattacgcttttggaaaaccagatcctgttcctggcactgtcactaattaactgggaaattctgaacaagtcttttcatctctctgggaatctatttcctcatctgtaaaattactgaatgcagagagcccccagggtcctttccagcttatattctatgagtccatcaatctctatgtgattgtggaagtaaattccttgaaagagccacaagtatagctgctttgtaccataatcagcaaagtcctgtctgcatataaactcaagaaaagcgattgaaggctgatgaagatatcatttttagtttgtgttatgaagctggcttggataggaattagaacatggaaagcaataaagttttgaattgtactgaaaacttactatgtgccagactgacactctcttacgcattttacatcattatcttatttaatgtcaccgtaaaacctactgcataaataggtaacagtcccatttgacagattttaaaaactaaggctcagagagtttatgtgtctcacttcattaaaaccagtcttcttgagcccaagcataatatcataatattctcatattattctatttcaaggttatttggttactgtttttttttgttttttttttttaatggagtctcactctgtcacccaagctggagtgcagtgatgcaatctcggttcactgcagcctccacctctcccggattcaagaaattctctgcctcagtctcccaagtagctgggattacaggcacctgccaccacgcccagctaattttttctcatgtatttttagtggagacagggtttcaccatcttggccaagctggtcttgaactcctgacctcatgctccacccacctcggcctcccaaagtgctgggattacaggtgtgagccactgtgcctgtcctatttcaaggttattctaatagttccatcgctcccaccatttacagtacccaaactatcaaatgacaaataaactcattaaaatttgacaataactaatatgtttctttcctttccaaaagaaggctactcacttcttggcttcactttgctcctctctataaggttggttcaaccaactccaggtaattctctaacttaagatttacacacatattatatcaacattaaaggctaacttgttaaagcttcatgaaaatttagagaaaagccagtcatcattgattatcttaccagttcacaaaaacattttttgtaatttattattactgtaatagaacatttgttattatttcaatcaacttctaagtgggacctgtaaggaaagtaaaaatcgaaataaaactacaacaaaatgtactcttgacatgttggcagtcttctcaagaagggcttgctacttatatcttaaacacctcaaactaattgtaaaatacttcctcacacataatccaaaataataacttctgaggatatttctacttaggattttaatccaaaattaggagaggaaagaaatacctgtctatctatccatatggaaacatttacctatctatattccacagatgcactgacaaggaattcaggcattaggagagtctttatattgttatatgtaatcaaatcaccagtcatcagactcttctccaaggaattccacttcttgatggttatccagaatactgtgacattgacatgcaaaatccaagtttggatccatctacttattggcctcagaaattgatcatgtttgggaaaattccaagatttagagatctgcaccaacagtgttaacaaagagcaggatatagtgtgatttccattgctgcagtcatagtctgtgaaatgccaatattctgcatatcttcaaagaacagaatctgtctccaaaaactgtacaaaatagcccactacaaaggaaaatccttcaagatctttgctattgaacgaggaccagaaataagaggaaaacttccgagaacagtataaaaatgacagatataagaggaggccaagcatgccatgaaatgagacactttttgctgacagatgagcacctttgaactctaacccaataaaagaattagcactcccaatgtataatcagtacagcaagcaaaatatgtcaacacatgataggcaggataatcaatcgacatgcgaggtaggaaacagccagactaaatagcaacccagtcccactgagccagacaggccttcctgctccttcaatttctcataccacagggaccaggaattaatatgcagtaaaggaaaacttctggtaagtaaaacaacagagcaagaatgaagagttctcactaagaagtgattaggattcccaaaacacggtcttgatgtcttgatttttttagatgtgttctttaaagaactttctcctgtcagatactaaaaactttgaaattatcaaccacagtactattatttattctcctttcccatgaagactacagaaatagtaaaaagagcaggcactacggacataaacagagctagcttttaatcctggttggctgtatgctaaccactgacctcaagcaagtaacgtaagcaggctgggcctcagttttatattcatctgttaaaaacagaagaataacactttttaaaaggagatttgtgacaattaaaaaaaaaacagaataggtaaagtgtcttattcaacacagatttgatattggcaatcccagtctcctcacagctagcatggtgtttccaaccctgtgagtgcttaagaaatgtggagatgccacatatattaaataataaactcacagaccacaacagagtaatgtagtttcagacatgcttaagaaggggggaaattggcctaggttagaatgccctatttaccatagctctgcaacagtgagagagtcacctaacctctctgggtcacagtcaactcatttataaagttgagcaaataatatctcaccaacctaaggcccgagctgagaagagcgactctcacagttcctttcagctttagatcactcattgcaaattatctgttgctagtttatcttatcttatgctctaacttgataaaatcgaatagaaattgcttcaattcctaaatctacatcccttcaggaatttgaaaatgattactttgtcttattttgcttgtgttttccattttcccaaaggagagttactagtgttctctgcttaaaatcacttagcaactctgcagcattttcatggcgtggtttgaatggtttttgatagcaatttgttttaaaatattatcctcaacctatctagccccaaaccacaggtgagtacattttgtaacattttacactcatgccatctatatttcaagattctgcctgctttaaacagagtagttttgtgtgatgcagtactttatttttcacttattttaaatacatttgtttttcaaatagacgctttgcaagaatgactttccagctatacattttgaaaccctcataactgtactcccatgactttagcagcacttcaaagggcaattttcttcactgaccatggcaaatactatttgaattagctaacaatttttctttggattcatgagacagaagagcatgcatccattgaagctaggctgatcattataattttaacactactgagaggatagtaacctaaagtcagagaaaacgcaatattgtgggctttcctaaacaactgcttaaacttgtttctcttttctgacaagtgtggatatagacaaattcagatattctagtatttatcattcaccaatactatggctacaaaaatgaaatctgaggcctaatttgccttataattcagaaactgaggagctttcagacagcaacaataagtcatttttcacgtttattttccatgcacataaagacacaccactctgccatcaacatatcaggcgaaatcaaaaatggcttagcacaaaaattacccagagaatggccatcagaaaaacagttgtgacaaagcaactatgctaaaattgtaccttaacttgaattatatttgcattcatttgcttcctaatacttttggagaactttgtggagaaaagactgggctttttgttcagtagtttttaaaatatcaaacgttctgtccatcagctatcccttcttggatgtgacaatgtgatagaataaagaccgacttttcttttggaacctcattgacatggcctttggcagcttacaagacctgtcttcacttattgtgtcctttgtaccctgatgccttcttataaggaaggacaataagagaggcctatgacaatatctcaacttttccccctggagactgagattccatggttttttgtgaaatccagcatgagtaatacttgttatcagagaagaaaagcgctagacaaataggaaacatcatttgacatttctcctccacatttacaaagttaagtgagttgtggaactgtgcctaggagggaataaatatctcatcacaaactagactcaaccagtcgtgcccattgacgcctatcaaaacacagccgcccttttcctttcattctgcttggattatttagatttctctaaatgttttcaatgaactcaaagactagttatttcaggacaaaataattgacaatgcaaaacattgtcattattttattatctgcagagttgtccaacggttagcaaaaattaaaaggacttacccatagtccacaaaaacatgaaatgcttagtcttctatttagatagaatcagggatagaaatgaattgtaagcatagctcctgcccattttccactactgaatttagtaatcttgtctatctccatatgaatatatgcatatacataggtttgtgtgtgtgtctgtatatatgtatcaccattccatatgctaacaaatgtggaaaggtcctttactttcttaggatgaaactattaaactacatataaatatctgaagactttagtaagagaaactgagcctttcaattttcattttccaaatgacactattgccagaaaaaaaaatgtttggcaaaactctttgctttctaagcattaagaaaaagaaggtcataaaaccgaaaggaaagatattgctctctaaagaatccaaatcccaaactaaccacaagcaggaatgtttataaaagtactttcttgaaactctctctgttagatatttcatgctatagaaaaatccttctgtaaagaacatcagtatatcatggactcagcttgcaggttaaaacccaaggataggcactgcactgtgaatttccctcctgactgtatgaagaagctgtagaggagatgtatgcttggtttcctgacgtccgcactctgagaggctccactaatccaaattgcatattgtgactccagatggcatttccaatataagaacaatgacttctgcaaaagcaccaaagagcccaaaagttgcaaggccaggtgccatccacaccttacataaatatttatgttaaagaatttctgactgggcgcagtggctcatgcctgtaatcccggcactttgggaggccaaggtgggaagatcttttgaggccaggagttccagaccagcctggccgacatggcgagacattgtctctactaaaaatacaaaaagtagccaggcatggtagtgcatgcctgtgatcccagctactcaggaggccgaggcaggagaatcgcttgaacccgggaggcagaagttgcagtgagctaagatcaagccactgcactccagcctgtgcgaaagagcaagactttatataaaaataaaaataaggctgggcacggtggttcatgactgtaatcccagcactttgggaggccaaggcaggtggatcacctgagatcaggggttcaagaccagcctgaccaacatggcaaaaccccatctctactacagacacaaaaattagccaggcatggtggtaggcacctgtaatcccagctacttgggaggctgaggcgggaaaatcacctgaacccaggaggcggaggttgcagtgagccaagattgcgccactgcactctagcctgggcaacagagtgagactctgtctcaaaaaaaaaaaaaaggaataaataaaaattaaaaagataaaaataaattaattaaaagttttttttaaatttatttgggttatttttattacaatgatcttactcttgaaaatccatgctgttttccataaaaagaaagatgatgttccctgcgtttctcatctggcttctgtgacactcctttggcaattcttgcgtatgccatcaaaatcataccagacaaatgctcctgaaagctacgatctattgattttcatagaaggattttccccctacagctgacaaggaaaacaagcatcttccaaagaaaattaaggtaaatgccaaaatgtctcatctcttcccagtatgaatcctttaaaaatattaattataataatgtttgacttcagaagaaaggcaaaaaggaaaaatttgagtcaggtgtgaagaacattaggaatattatgatctaaataatataatataactgaaacatataagaacatcactaattttcatttgactataaaccaaccactggcttttcaaatgattggaacaatctctcagtttgggttacagcttttctcttcaaaagtttaaactgttcagttcagtgactgttgaatttcagctcctgaaatactgtataccattgagcacttacttttgtgttttattcatggtcaagataacaccagtgactttaacaacccctgcactttattcaaattgttttagaaaatatataaaagcagatttccttttaaaaacatagttaggaggattcctgggcaagatggccgaatagaaacagctctgatctgcagctcccagtgagaccaatgcagaaggcaggtgatttctgcatttccaactgaggtacccagttcatctcactgggactggttagacagtggttgcagcccacagagggcgagccgaagcagggtgaggcattgcctcacctgcaaagcgcaaggggttggggaactccatcccttagccaagggaagccatgagggaccgtgccatgagggactgtgatttctggccaagacactatgcttttcccacagtctttgcaacccacagaccaggagattccatcaggtacctacaccacaagtgccctcggtatcaagcacaaacctggggggccatttgggcagacaccaagctagctgctagctgcaggagttttttttttgtttttttttttatttttttttttgtacccaagtggcatctggaactccagtgagacagaaccaaacactaccctgcaaagggggctgaagccagggagccaggtggtcttgctcagtggatcccaactccatggagcatagcaagctaagatccactggcttgaaattctcactgccaacacagcagtctaaagacgacctgggatgctccagcttggttgggggagggatgtctgccattactgaggcttgagtaggtggttttccctcacagtgtaaacaaagccaccaggaggtttcgattgggcacagcccacctcagtgcagcaaggccactgtagtcaaactgcctctctagattcctcctctctgggcaagccatctctgaaagaaaggcagcagccccagtcaggagcttataggtaaaacttccatcttcctggaacagagaacctgggggaaggggcgactgtaagtgcagcttcagcagacttaaatgttcctgcctgcctgctctgaagagagcagtggatctcccagcacagcactcaagatctgctaaggggcagactgcctcctcaagtgggtcccagacccccgtgcctcctgagagggagatatctcccatcaggggtcaacagacaactcataaaggacagctccggctggtatatggtgggtgcccccctggtatgaagcttccagaggaaggagcaggcagcaatctttgctgttctgcagcctccactggtgagacccaggcaaacagggtctgaagtgaacccccagcaaactccagcagacctgcagacgaggagcctgactgttagaagaaaactaacatacagaaaataatagcatcaacatctacaaaaaggacaaccatgcaaaacctccatccaaagatggagcaaagatgaaaggtagataaatccatgaagatggggaaaaaccagcacaaaaaggctgataattccaaaaaccagaatgcccattctcctccaaatgatggcaactcctcaccagcaagagaacaaaactggacggagaatgagtttgatgaattgacagaagtaggcttcagaaggtgggtaataacaaactcctccaagctaaaggaacatgttctaactcaatgcaaggaagctaaaaaccttgagaaaaggttagaggaattgctaactagtataaccagtttagaaagaacgtaagtgatctgatggagctgaaaaacacagcacgagaacttcgtgaagcatacatagtatcaatagcccaatcaatcaagtggaagaaagggtatcagagattgaagatcaacttagtgaaataaagtgtgaagacaagattagagaaaaaagaataaaaaggaatgaacaaagcctccaagaaatatgggaatatgtgaaaagaccaaacctatgtttgatgggcatacctgaaaatgacaggagaatggaaccaagttggaaaacacacttcaggatattatccaggagaacttctgcaacctagcaagacaagctaacattcaaattcaggaaatacagagaacaacacaaagatactccttcagaagagcaaccccaagacacatagtcatcagattcatcaaggttgaaatgaaggaaaatttgttaagggcagccagagagaaaggtcaggttacacacaaacagaagcccatcagactaacagtggatctctctgcagaaaccctacaagccagaaaaaagtggaggccaatattcaacattcttaaagaaaagaattttcaacccagaatttcatatccagccaaactaagcttcataagtgaagtagaaataaaatcctttacagacaagcaaatgttgagggattttgtcaccaccaggcctgccttacaagcgctcctgaaggaagcactaaatatagaaagaaaaaactggtaccagccactgcaaaaacaaaccaaaatgtaaagatcatcgacactatgaagaaactgcatcaactaatggacaaactaaccagctagcatcatgataggatcaaattcacacataacaatattaaccttaaatgcaaacgggctaaatgccccaattaaaaggcacagacaggcaaattggatcaagagtcaagacccatcagtgtgctgtattcaggagacccatctcatatgcaaagacacacataggctcaaaataaaggggcagaggaatatttaccaagccaatggaaagaaaaaaaaagcatgggttgcaatcctagtctctgttaaaacagactttaaaccaacaaatataaaaaaagacaaagaagggcattgcataaaggaatcaatgcaacaagaagagctaactatcctaaatatatatgcacccaatacaggagcaacgagattcataaagcaagttcttagggacctacaaagagacttagactccaacacaataataatgggagaatttaataccccaccatcaatattagacagatcaatgagacagaaaattaacaaggatatccaggacttgaaatcagctctggaccaagtggacctaatagacatctacagaactctccaccccagatcaaagtaatagacattcttctcagcaacacatagcacttattctaaaaccgaccatataattggaagtaaaacactcctcagcaaatgcaaaagaacagaaatcataacaaacagtctctccaaccacagtgcaatcaaattagaactcaggattaagaaactcactcaaaatcacaaaactaaatggaaactgaacaacatgctcctgaatgactactgggtaaataatgaaattaaggcagaaataaataagttctctgaaaccaatgaaaacaaagacacaatgtaccagaatgcctaggatacagctaaagcagaatttaaagggaaatgtatagcactaaatgcccacaggagaaaatgggaaagatctaaaattgacaccctaatgtcacaattaaaagaactagagaagcaagagcaaacaaattcaacagctagcagaagacaagaaataactaggatcagggcagaactgaaggaaatagagacacaaaaaaactcttgaaaaaaatcaatgaatccaggagctgtttttttttaaaaaaggatgaacaaaatcaatagacttctagctagactaataaggaagaaaagagagacaaatcaaataggcacaataaaaaaagataaagaggatagcaccactgaccccatagaaatacaaactacaatcagagaacactgtaaacacctctatgtaagtaagctagaaaatctagaagccctcagaaataacgccgcatatctacaactatctgatctttgacaaaactgacaaaaacaagcaatggggaaaggattccctatttaataaatggtgctgggaaaactggctggccatatgtagaaagctgaaactggatgccttccttacaccttatacaaaaattaattcaagaaggattaaagacttaaacgttagacctaaaaccataaaaaccctagaagaaaacctaggcattaccattcaggacataggcgtgggcaaggacttcatgtctaaaacaccaaaagcaatggcaacaaaagccaaaattgacaaatgggatctaactaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatttcacaccacttagaatggcaatcattaaaaaatcaggaaacaacaggtgctggagtggatgtggagaaataggaacacttttacactgttggtgggactgtaaactagttcaaccattgtggaagtcagtgtggtgattcctcagggatctagaactagaaatactatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaatgatgagttcatgtcctttgtagggacacggatgaaattggaaatcatcattctcagcaaactatcgcaagaacaaaaaaccaaacaccacgtattctcacttataggtgggaatcgaacaatgagatcacatggacacaggaaggggaacatcacactctggggactgttgtggggttgggggagcggggagggatagcattaggagatatacctaatgctaaatgacgagttaatgtgtgcagcacaccagcatggcacatgtatacatatgtaactaacctgcacattgtgcacatgtaccctaaaacttaaagtataataataaaaaaaaactaaacaaaaaaaaaaaaagaaaatctagaagaaatggataagttcctggacaaatacaccctctaaagactaaaccaggaagaagtcaaatccctgaatgcagcaataacaagttctgaaattgaggtactaattaataggctaccaaccaaaaaaagcccaggaccagacagattcacagctgaattctaccagaggtacaaaaaggagctggtacgaatccttctaaaactattccaaacaatagaaaaagagggactcctccctaactcattttacgaggccagcatcatcctgatacaaaaacctggtagagacacaacaaaaaaacaaaatttcaggccaatatcccggatgaacatcaatgcgaatatcctcaataaaatactaaaccgaatctagcagcacatcaaaaagcttatccactatgatcaagtcggcttcacccctgggatgcaaggctagatcatcatacacaaatcaataaacgtaatccatcacataaacataaccaatgacaaaaaccacatgattatctcaatagatgcagaaaaggccttcgataaaattcaacaccccttcacgataaaaacactcaataaactaggtattgatggaacatatgtcaaaataataagagctatttatgacaaacccacagccaatatcatactgaattggcaaaacctggaagcattccttttgaaaaccggcacaagacaaagatatactatatcaccactcctattcaacatagtattggaatttctggccaaggcaatcagtcaagagaaagaaacaaaggatattcaaataggaagagaggaagtcaaatggtctgtttgcagatgacatgattgtatatttaggaaaacacattgtctctgtccaaaatctccttaagctgataagcaaatttagcaaagtctcaggatacaaaatcaatgtgcaaaaatcacaagcattcctatacaccaataatagacaaacagagagccaaatcatgagtgaatgtcattcataattgctacaaagagaataaaatacgtagaaatacaaatcccaagggatgtgaaagacctcttcaaggacaactacaaaccacggctcaaggaaataagagaggacacaaacaaatggaaaaatattccgtgctcatggataggaagaatcaatatcataaaaatggccatactgctcaaagtaatttatagattcaatgttatccccatcaggctaccattgactttcttcacagaattataaaaaactacttcaaatttcacatgtaaccaaataagagcccatatagccaagaccatcctaagcaaaaagaacaaagctggaggcatcacactacctgacttcaaactatactacaaggctacagtaaccaaatcagcatggtaccagtggcaaaacagatatacagaccaatggcacagattggtcttacaccttccttacaccttatacacaaatcaactcaagacggattaaagatttaaatgtaagacctaaaagcataaaaaccatagaagaaaacctaggcaataccattcaggacataggcataggcaaagactccatgactaaaacaccaaaagcaatggcaacaaaagccaaaattgacaaatggaatttaattaaactaaagagcttctgcacaacaaaagaaactatcatcagagtgaacaagcaacctacagaatgggagaaaatttttgcaatctatccatctgacaaaggcctaatatccagaatctacaaggaatttaaacaaatttacaagaagaaaatgaacaaccccatcaaaaagtgggcaaaggatatgaacagacacttctcaaaagaagacatttatgcagccaacaaacatatgaataaaagctcatcatcactggtcattagagaaatgcaaatcaaaaccataattagataccatctcacgccagttagaatggcgatcattaaaaagccaggaaacaacagatgctagagaggaggtggagaaataggaatgcttttacactgttggtgggagtgtaaattagttcaaccattgtggaagacagtgggtcttccacttcccaagttcaagcatctctccaccaatcaactactgttgggcaagatcagcagttttcccaggcatagccagagtgatgtcctagaaagagctctgacctgcaaagcatggaagcatgggacctgcattatggctccaatccctgcagcaaacccaccatgaccacatctttaaattcccatggtaagttgggctgggtgttctctaagattcctttcaataccaagaacccatggatctgaaattcaaattatggggaaatgttgaaaatgaagaaacagaagaaatgtagcagtggtttctttttatctgaacaatgaggcaaatagcaaacatatttccttataggaagccggcccctagaaatagggaatggcagtttcctccacggacacaattataggtagtgaaaagggagaagagagccccactcctctggttcaactatgaatcattttcaaggaataggcttgactcatgactcaatttttactttcaatttctctcaaaaatgaagaactgaattttcaacctcactaaccaagcccataattcctaagaatatgatgttttaatataggatggtcactaaagtgttattgaagatgctttaactgaacatgaacatgcactttgaaataaaataggtatgtataaatgaaccttgaagataactaaaataaagtgtatttcatcaatattccattgaacacaattttatgtagggtgtgttttcatctcctgtaaaggaccctaacattccatagaatattatattatagtaggcacatttggcaatgatgacagtgtactgtatttttcttgtaactacatctccgatgaagtcactgcagtcatgacaaactccagtcccactggaatgaggttcagagaacggactaagaggtaggacatggtctaagggaaagggttctattatctgtcaaaaccaggtaaaaagggaaggtttctagttctttgaaggctaaacgattaggttctgatggcttttaaatgttgatcatttattattaatatgaaagatcattttaaaatgtattatcttcttgtcttctcacttttgtgaacacaattgtacatgctagaatttagcagattcaggacactgttaaggaatgtggagttgtttgccatacaagaagtacttctagattgctgtgctgttctaaatgacatttttcctttctccccatgaggcccattgccaatctcctttgcctgttggtcagtggaccattggcagtagatctaattcttgccagctttctagtgcatcttttacatggtctcatgtttgctcttctgcttcttaacactgtcttcttcttgctttcctttgatctctttcttcctgcctccttacttcgctgccctgttcttacagcctaggctaaccaacgagaattctcattttctgtggttggcaaaccaatcacttatagcatgtttgtttttttaaaaaaaaaaaacaaaacgatttcttacttcttcatgtttacaattcttttctgcattacgattggaagatatcactgctcaggctcagaaattctcaggtatttctaagttagcaacttccccagaaggtaagaggtgagagcctgaagaataaataggtggacatgattaaacatctcttgtctctaacatagattagctgtaataatccaagtgaaaatctgggcttctgaagaataattagcatagaataaagaattgagggtttaactttctgtaaagaacctggacaatcttaagagaaacacgatttatgcttcactatataatcatctatatttcataaacaaataacaattgtaagttttatttttgctctttttattggtttcttttttaaaaaaagatagatgttatcctagttaccagtataaggctcatttgtaccaataaatactctcaattatatgtttgaaagtcagagttctagctgagactttattcacatccctttgttattttatttgttgcctaagttgctgtgtgtgtaatgttaaaacttactgggaattagtgtaataatgaagagaaaactgatatgttctgtaggataaaatgaatgccatgatcattcacattccttaatggtgcttaatctaatcaaagtccaagccaaaaagcaaatacataaaactattaataatgcaactgagtttacaccagaaacaaaatatgttattcatataatacagcaaattacagagaaagagtaaattttcttttcacatatacaaaacttcatatttggttgcttcttttctttctttcttttttgtttacctagaacccaaaagcttttgtctaacagttcagatcacattcttttgaatggaaaggaatttatgtcatttaatggagtcaagaaagacaattattcacattttaaagatatagaacactaaaattttcaaaaactcacaagccttaagaattaaatttggccttttggcagagattcacctacccagatcccctgaatcatatgcataacgcagtgaaaattttatggacttcatagtcaaaaaatactccctttaaatccaacttctgtggctcaccagcatgcaactttggacaagttactttatctttctgaagatctgtatttttttatatgtaaaataaaatactaccaattttgtggagcttgaaaataagagacatggtacagcacaaagaaggtacacaataaattgtaaaaattgcccttatttttaaaaagagtgctctggtaagcagaaaaaataactaaattggggtcatgtgtctactagtgcttcccaaaccgtaatgtacatagaaattacctgagttcttcttaaaatgcaagctctgattcagtagatctaggtgaaccctgagattgtgcatttctaataagctcctaggagattctaatgctgctggtctatggatcatactttgagtagcaagactcactaagaagctagactctaagaatcattgcaatgtcactgattcacaaaaggcagaagtttctcaaaggaagatttcacacatcgaggtatcaacaggaaaaagaaaacagaaaaattggtactttgcataagccaattaacctctcttggtttcaaggaaggcaggggtttgcctaaagttcctttctgttaaaaagttttatgtttccatagagcttgtaaccatacttttctcaatttcaagttttccgatcacctgaaaggggaaactgattatttgtaaggggaaactgtatagaattccttgcagatatttaacctcagtgaacagaaaatctctccttattttggaagaagataaagaaactatacaaaagatgatcaaaactaatcagatttatcactggatgggaatccttggtagatatctttgaaattagtgagaattttttagcattttcctaataagatgccttattaataggaaacatgcagggatcaccaaatattaactccatcccatttctgatgaggaggctgaggtctgggggagactcatactttgtccacactcactagaagcttccaagcaaagacaaagattcagttctcctaagccccatttaagctgcctccgaagttttgaatacttcttttctgatatgaaatcctcattatgttattaattaagccatcattaattgccaaagaggtaatatgtaatctagaaccaaaaccaagctgggatataagtagaagacagatgtgccctgacatagtggatgatatttactcagtttccgatggtcccagagatttagtctaagatgcaacaagccaaaaaatgtagccttcttcctctgccagaatttatagtcaaatgcttaaagtttccattaagcccatgacatttcatcatcttctcaacagacctgtagttattccaattgaaataaagaaaaactcagtgttctgggagaccacctcctgtaggcctggctcaagagctcaatttcttagtctgaccttgaaaactaagacaagcatcatcaagactgctgaggtttcgtcaaattcctaccatgcaaagaccatgatgctctggtttaaaagctgaaaatagcatcctttcggtggcacagctaaaccctgcaactgattttatggtagtaaaacttcagggaagctttcaaagtttttctgatctgattggcagtgcatttctctaagtctaccatgacttccagaacaagttggcggtccatctccagttagtctaaaaaagtcacagctcatgacctctatgatcagagacctagaagacacaattgtacaaacctccatcttgaccatcatgtgaaagaagatggttgttcttctgaagggtacacaatgtgaaacatgactggcaagttttctccataaacagagcaaatctcttccctcacagagctgcctttatttgagcaagacatttgcaaagcttagagtctccttgaatctattagaaacccttccctgagtgaggaaacagacattgtaaatgaaccatgactcagaaacccccttgtaccagaaaatatcctacagattccagaggcattttatgttctattttcctgacatactagttctaactatctgattcatttatttttttgtttaatgctttaaccagtttctgcagattattacagtcaaacaagtgatttctttcagggttagtttttttttctccttctgactttggaagggtttcagattcagttgaaggaaagactctgttatatactacagaaacactcaacaccatatattcagcttaactacaataagaaaagccagacccagatgtcccaagctaaatcgagggaaaagaggaaaattaaaatttagtgttcatttgcagaaacccccccccacttgcatgtgcctcagataaccagttggaatcaacgaaaatttataagcttacagaataaaaatctaattctcctgtctcagaggaccttggagcactttcaattttttatgtactacacagatgacttcagtggcaccagatcacttatcaattaagagagaagaaatgtgcatgtccatgctctttgcacgagaaaacggagctatgattaacaatctcaagttgtccatacacttgatctgcatttaacatgcaggcattctctcaaattctatccagatatggtcatagttgttgatacaaatcaaaaattttaaaaagatctgagctttaattcagaaattccatttacagaaataagattatgcaagaaaatgtatctaataaagagacaactctatgtaacatttgttgattatgaattaggccctgtactaaaactttatatctagtgtcttcgagtcaccctatgaggtatgtccgaccactatattactttacagctgaggaaacaaaggtttagaaaaggcattttgattggtcaaacagtaagcgatagagcatatttaaaagcccacattcttagccactttattttgctgtgtctgagtgttagagcattatttataataatgaaaaatctaagcaatcaaatgtccaacaatagaagctttgagaaaataaacacaatggaattcagtgcagccatatgttgaagaagaatagtattctacaacatgggaaaatgtttgcaacacagtgagtgaaaaagtaaagcaatttttcaaagcagatagcatagagccttttggtaacaggatctatacagaaggaaaaaaagatgaaaagataacacatggataatgtggaaggtggttatctctgagggtgagcctgtgtattatagttttctttgctatgttttgtattttaacaatattctacaataaacactgcagaaatacttttctatctgaaaaattaatgaacaaaatggcagccattatctagtaaaaatccccccaacagttctccctacacgaaaatataattttggctgagtttgctccatccattgtaacacagatttctttttgcaaaaagcctatgtgaaaacttcagctaaaaaattttaataatattttaagaaagaagtcattagcattttcccaatgattctgtcaggtaagtacatgctcctttgggagaccctagtgacacagttcagtgggaaagtcatttaatatcttgaggcacaatctaagctaaaagttacagcacaacttcaagacggtggacactcaggcagggaaaaggaacctctgatgctcaggcatgtcaccaggagattggcaaatggcatcgctgtgctcataggagacacctggagcatccaaacatggtggtgaattaatgtttgccttccatccttctcagttcactcaacctgaaaagtgtttttcaccttttgaaatccgtctgatttaaagtcaatgaatagttttctgcactaatagcatgaaacatatgagaaccagtttatagcagtcacaaatttagtaattgctgaagtaaaagggctagaagagtaattgcagttaatatgagattaattgagctgcacgtggagcagagaagattgtgcaagacagtcttcagaatccttcttccaaatgcaaaatcataaaatgttggtatcacttaggcatccagttagtaacataaggctaacagagaatgtaggaggaagagactgcatttaatgaatgcctactatgtgccagatattgtatgtatacacgttaaatctttgtgacaaccctattaggtagaaattaatcaacccccaatttacaaatgaggacattgaaaaccagagaaatctacattcagagcctatattctttctactagattactttttttcaataacaagcatggatatataacagagagcttctcaaggtatgaattcttttttaaagcctcttcgagctttttataattattggtattccctttccctcacatgtcacagaaatactaatatgtaaactttttagtatttccaattcattttttagtaaaaattatgatgtttaaatgcatatattatcatttaaagtcacagagctatgctagtctctgtattctttatcaagtgctgttatttttagctcttaatgtagtataatagctttgtattttgttaaggtaaaggatttgcacttcatttaggtgagtctaggtagctaattatgtcaaagaatgaggttttgagtatactataggccgatattttcacacaaattaattcttggtctaaaataaaaggaaacctcttcagctattcaaaaggaagtcattgtccttactgactataaataataatagggctttatcttgtccatttggttattaaaaagaagatgaacttgtgttgaccaaagaactggtgaacttgatgtggtgaagctaatggaaatctccactcagatgtgagttatgtccaggtctaagttttttgcagcaatctcttgtacagaagatggaatcacgagggagagaatatttattaaaataaaaagcatcccatcacagagaggagttgagagattattgctatcttttctatcattgtaactccttttcaggacaaaatatgtgtgtatgaaagatagctaagtggtaactagagacagaaataaattaatgaagtggtgagttcaattgtgtctcctcaaattcatatgttgaaatcctaacctctaatacctcagaatgtggtcataaggaggtagtctttaaagtgataattaagttaaaatgaagtcactaaggtaggctctagtccaatatgactggtatccctataagaagaggagattagaacacagtcaatgcatgggcacagagaaaaggccatgtcctggtggcaggtgcctgtagtcccagctacttgggaggctgaggcagaagaatcgcttgaacccgagaggcagaagttgctgtgagccaacatcacaccacttcactccagcctaggcaacacagcgagaagaaaccaaccttgatcttggacttccagacttcagaacttcaacaaaataaatgtctgttgtttaagccagtggtccccaaccttttgtaaaccagggacctgtttcatggaagacaattttttcatggactgtggggggttggttttgggatgaaacttccacctcagatcatcaggcattagattctcataaagagcctagatccttcacatgcgcagttcacaatagggttcacttgcctatgagaatcgaatgctgtcagtcatctgacagaggtggagcttaggcagcagtgctcacctgacagctgctcaccttctgctatgcggcccagttcctaacaggcctaataacaggccgtggaccggtactgcaggattgcagacccctgctttaagctactcagtctatggtattttgttatgacagccctagcaaatgaatatataaatcttaaaatttgttggaaaagaatatgctcatgaggtcatacacactctattgtaccttttttctacttgcaaaatatcttttacctcaaattattttttgtaaacaaaactcttaaggctattatctactttttcagaccaacaaactaaaagaatgagagcttttgtggtaaaagggattggaatcaaaggtcaatgcccttggtctgggttttcaccctgacatcacctggaagtctctgtgctaggcactgggaagggaaaaaaataaaagaaaggtgcaaagaaaatgaaaagagactctgtcttcaagaagctcatagtctagagaaggagccagacacttggatactagaaaacaaagccaaaaatatatgaatgtggtataaccaaagagccacaggaacaataggcagaatataattaattttagctaaggatatacaaaagatatcatgagtgtcagttgaaatgagagactggagtcaactctaaacttccttgtcaatataaaatgctgtggtaacagccagaatgaaaactcagaatacttgatcagatatgctgtatataagcttttcctgtcattccagctataggatccccaaactgctggacaattcaatcaagcttcctattaaaccactgtgtataggtgttacgtgtgtgggtgtgtatctgtctgtcttagggttggtgtagagaagattcacttttttaattaaataattttgcagtataaagaatagattacattgactcagattcagtctaagcagtgaatgtaacctcagatgcaagctgcaaaatggaaggaatgtatctatcttattctccatcacaagctcagagactagcatgctatctgacccatagcacatgttcaacaaatatttgttgcctgaatgttgcatggatgagtaaacatattttctaccagatgagatgtaaagtttatagggagaaaacatcttgaaaattcggctctagaaatatcctaactcatacatgtccagtagctagatgtagtaacaggtttaatgggtttaacatgaaaagattttagttccaggcccttccacacttaatagttgcataccttatactgtgtcactaatccctcttagtctccatgtcattattggccaaatagagtcaatgatattaccacttctctacgtcagtgtattgttgtgaagatcaaataagatattgtgcataaaaaatcctcaacaacaaagcaagaggaatggcataaatgcagaatcaggtagtctctgtgttgcagagtcccactgtctctcctacagctgaaagttcaaagatatagcttgacttgtactttgcagaagggcacttaactctaaaagaagaaaataaactttgaaaaatgattaagaatggcgtgagtttagagaagttagaagtagaatgttcattgatgccttccctggtaagattctactttgaacagtaagtctattccattcatagaactagctaaaggtaatttgtttttcaataaatcctcatttccaatattctggatggcctctggcagaaaatgttatatagctataaaatgcaatctttcatcagggccattttaagacttttgcctgtcctagctacttaattttggaagctgcatcctatgttatatcaaaaattaaaatgtaaccacactctatatttaacataattaaaacacaactctagatgatttgaattatactggactggatgacatagtactacattaataaacatttattaattgtgattttatcattttcattcatatttttaagccagtaatttttttcaagtaattttttaggcccttggaaaactaatagctctcaggttctaggcttacagtggtaacagataaaacaattcctgtatttcataattgtctaattagttactttgtataattgcactggattttgaataaggagaaaaaggcctcccgcactatttcctagtaatctgtgtccacaagtctattttccctacctgctatgtttgcctaagactggtcatttgttacctgctagttccaattgatttcctttgcctttgcctcctttagccatgagtgcaaagaacagaccatacgatttataccagccatctagtaccaatcattagataacaagaccctttactgaaagcatttagagtaaaacaatactttaggtttacctttgctttcatttccttctttattacactaggttcaaagtgaggccaaaaatggtatcacaaggcctatttagacatccaagcaaagaatgccaagtcattctaaataaatcccccagctgcagtagaattttacacattttcaagtgcaagtttctaataacatttttgggcttgtttttccccttgtctgtttcagtcactgtctttatatataaggggaaatgagtcatattaaattatgctccagcaaatgtcctataaagacatatctaagccatcctgtttgctaataaaaagataagatttgtcctctgaaagaagcaaggttgaactatgccaaagagcttacagccagagttagacaaacccaaagtcattagctggtggggaaatctgaacttgtggcctttcttcaagtgggaggagtaggaagggagtagcagggacctgtcagccttggaaactcaagcttgtggcgagaggctgggaacttcctgtggttactaagaggctgcgataccttgcatagatgtcctgataattgttttctaaagttggcactgcctactggcttaccgttgctagtagaacattatcaaaaccggggtcttccagaattataggtctctaagacctacatagaagaaataaaggtcccttgacctgttgccaaatggtaccacaagaaaaaaaagcccttatttcaaactttgagctcaagttaacttccctactttgtaattccctgatggattccctgatttactcacctgattagattcaaagtcgcacagactaatttcaatattttccatggtaaatacaattaggtagactggtctgccacaaatcctaaagccaaatacacacggttgtgagatttttagattctcctgtttggggttctcaattcagtagcatgaattagtacttacatatagaaatggctaagagcatccagcataccaggtaaatgaggtgtaaggcaacacgagatggcacagaccaaggggttaggagaggccatgctccatctaaaggagggagctgctatcaggtatggctgagtgttgccatggagaaaactggtttgatatggccacataatctgatacttcaagataaatcagaaatttggattttggggtgaggtttttcacctttttttttttcacattgtgttagccaaactacatgtgtctacaaactgactgtaggccagagagacaacagttcgagacctagtatgaatcttgtttaattctctccctttgtcatgaagaaaagtgatagttccactgtcatttttgtgatagtactactgtcttttttttttttagacagagtcttgctctgtcacccaggctggagtgcagtggcactatcttggctcgccacaacctctgcctcccaggttcaggtgattctcctgcctcagcctcctgagtagctgggattacaggggtgcaccatcacactcggctacttttgtatttttggtagagacagggtttcaccatgttggccaggctggtctcgaactcctgaccccagatgatccactggcctcagcctctcaaagtgctgggattataggcgtgagccactgtgccgggctgtcatttttttcttctcattatttagccttagctgatctcaaagacttatgaaacagtaaagcagatgtcaatgtctccctctctaacacacaaacagacatatactttcttcattaaaaattacagaaaacatttaaaatatgaaggttcatcatgtggataaattatttcaacctcatagaacacaaaaagccctgttaggctatacatctatttcattcttcttctttactattgaattttaaaatgtgtgcacagtgaggtgacccttatatcaaagactacaaacagtgcttaaagatatgcagcacctttttaaagaaacacaccttcttataagcacagttaaaagggaaaaggttaaaggctacagtagattgttctattctgtgccaagattctgctccagctgcaactaaatagtggttctcaggcttaattaaataaagacccgtgtaaattctaactgtttactatgtgattagaacttctctgggcaaaaagctcatatttgatttccttgctgtctgcacttgcccaaaccctttacccaccaggtatgtactgaagctgtgtaaactcaacatttttcttttggaatcaagggtaagatataaaagtttatagaaacggtgagacccaattgtggaaaattcattttatgtaaatggaaaaaaagtattctatatattagaaccaatgttgtcatgatgaaatttctttgactaggccgggcatggtgactcacacctgtaatcacagcactttgggaggccaaggcgggtggatcacttgaggtcaggagtttgaaaccagtctgccaacatggtgaaacctcatctctactaaaactacaaaaatgtgctgggtgtggtggggcacacttgtaatcccagctattcgggaggctgaggcaggagaattgctcaaactcaggaggcagaggttgcagtgagcagagatcacgccattgcactccagcctgggcaacaacagcgaaactcgaaagaaggaaagaaaagaaagacagacagacagaatgaaagaaagaaaagaaagacaaacagacagacagaatgaaagaaagaaaagaaagaaagaggaaggaaggaaggaaggaaaaaaggaaggaagggagggaaggagggagggagggaaggagaaaagaaagaaagagaaagagaaagaaagaaagaaagaaagaaagaaagaaagaaagaaagaaagaaagagaaagaaagaaaagaaagaaagaaaatttctttcaataacattgagagcagtagtttttaacctttgtgaaaaatcatctagagtgcttgttaaaaatgcaaatacacagggcttgtccccagagatttactgtgactgtagggtgagacctttcaaatgtttgaacgcaggagattcaaagatcacatttggagaagcacctatctagagaaaaatcctacttccaagtttaacgttggagagctgttatctgaattcatctgggaaaaaaaagggtttattcttaataatggggaggtggcagaaattgcctctttaattttacccattctccaagtgtcaaaacgtaattgataattaagattatgttccctttaatatttttcaaatttagtttatttagataatgaataccacatgtccttcaataattttaaaattcagttaatttaaaaattgtataaatagattctgagatactaaacaaatatacagtcaaattttttatgttttcatttgaacattctggggaaaataagcatactttagaagcaagcacatataaatgcataattcagttaggttttttgttttaatttgtccttggcattgatgaaaaacaaattagctactctccttgggtgcctaccagaaataatagtaacaagttgagcttttttcctcctcagtaatatgttcctttgtagataagcacagtggagaggtaaaatgatgtataaaaagtttactgttttttttttgttttgttctaagatgtaaatgataggggaaggactgggagctatttcagaaatatttattccattgagacaatgaattttggtcattagaagaaagaatcatggactatcaaaatgaaacaaaaagacagcagatttatttctatagcaagtgtctgtacataaagagcaggcacacctcacaacattgtacatttattgtcttacaaaatgaactggggttgaggtagatgtagtaaggaaaaagctttaatgatgtgaggcaaatttttaagagaggagatgtttttatttttaaagaattcaataaatataatgatagtgttaaatgtttttgttgttttttctctcaaaactatttgaaccacttattaatctccagtctgtttcatcaatcttttatgatgtgttacaaggagtttctcaaatttaaacttcattacatcattttatagttataaaccctgaccactataattcttggtcctaactaggctatgaaaagaggaatgtattcattaggctagtacagtatgggaagcctgtagtttaaccaaggttaaaacaaataagatgccaaagttcacaattttaaataaactcaagaacctgaaaaagataatttaaaaacaacatagtgcatttctatagtttgtcattatttcatctcttatggaaatatgcagcaatgatggtctttttctatatctagaaaaaatacataagtgatttttaacagtaagaagttatttgtgtttggatttccttcgccacagcttccttaactagctcctgggtagaattcattaatttttattaacagggaaaacatttgttcccgtgacaatatttgcattgcctgaatgattttcacctctgccacaaggtgtactatcggctcatacatcacccgattacttggagagcagaaagaccctcagtcattagtgagtgaattaaagatgatcttaagagctattaatcacagtgacaaaagccttaatgtttctgtgaccctagtggagcctggggacccaaagggaagcagagggagagaaaatggaaacatatgttttctccaaaataacctaccttaggagaactgtcaaaaagagagtcacatcaaactaagaaattctgccagcaactggcctctggattatgtgtctatttatcttcttgtgaactcatatttccttttaaaatatatattttcttgctgtagacaattagagggccaaaactagtgtcttctgtatctttgatttcttaattccgtttatttagaacgacttgtgcttctgctaaactgcatttcttgaaaaaattcaacataaattgcattcagtctaataaccacataaatcagtataaaaacaagcagacaatagcagtaaagtgccattataaacattaattcaagcagatacaatattccaataatggaccaaaacggtaacattattaagcactacagtcggttacaaaacttgatcattcttcaatgtatctggctgtatttccctggatgtttacaagattataatggcatcaactccactgttaataacataggcacttgctggaatttcaattatctttcacaatatgttgacataaaaaacagactacaactggctatttctgaatatggtaagaagatccatatccccttatttgtatgcacgtctttgtttacatagctgaggaagaaatatcacattgtgcttatgttttgcaattggttctgagtctatgacgcaaaaaaaaaagggaaattctggctaaatcgcttttttttttttttttttttttgagacagagtttcgctcttgttgcccaggctggaatacaatggcgcaatctccgctcaccacaacctccgcctcccaggttcaagcgattcccctgcctcagcctcccaactagttagtattacgggcatgcgccaccacgcctggctaattttgtattttcattagagacggggtttctctgtgctggtcaggctggtctcaaactcccgacctcaggtgatctgcctgcttcagcctcccaaattgctgggataacaggtgtgaggcaccgtgcctggccctaaatggcttttctacacgtcagtttcttcaatacgatttggattagcaaaattaatggtgaaattatagttttctcttttgacattgatactatgttgccaaataaaaaatcctttttttcaatcacttttcagtgcctaatacagtaactaacacataattagggctcaaaaactatgtgttagactgactgaattggataaatattcaatgttatttatattgaaaaacaaatatgactctggattaagaatattaaaaatttttggaaattttttattctcaataagtttttatgttttgactaaagagtccaagtcaatacaactgaaaatacttgagcttgaacgacataacaggattattttattcattagaaaaaatatattttaagggtaattttctttctggaatcatagagaataaaagagaaaaaattatgaagaagttattttgctacggctaaaaataatttcagagtactttaaaagtctcgtgagtaaaataaaatcttttatgaaccaattagagttttgtatttgactttatgattcacacagctctgtaactagatttcattattttctccatctcccagataaggaaaccaaggcttacaatattaaactaatattctccactgtcataaatctaattgggggtggacaatgccagattttctggcttcaaatccagttaacttgccattgaactaagctgtgtcccaaatactttgaaatgcaaggaaaatgtattggttaactaaaatcaatctattaaattgggtctcagataaagcctagtttctatacaggaaggtttattgttaaacgtataggagacattcaaatattaacttttttgcaattattagtcataagaagagaaaagtttaaggaactcaaaccggatcccatgatagaatctccaagattagttaacataatattcacaaaagcaccttctttgataaccacagagattcaaattataactctctccatttaacagagtcaaactttttggaatgtaattcttggagacaaaaaccttctttatatatttccctcttgtccacctgtaacacccagcaaataggggtaaagctattcttgagttaaagaaaaatgaaaagcgtagatttatagagaaacgtgttttcatatggcatttttccttctctccaggtgctaaagggggtctcagagtagagttcaacacttagattagaactttttccttaaaagcaattagaaagttatttttgaatggctagaccagacttcctaaacttttagcagagcctaattgcaatgtcatatatagagtgacaagaaatgcataaaaatctcatcctcctaaaatgtatcaagggatgttttattattcaatggctccaggaaagtatacgacacaaccatgagccaaacactagttttagcactctacgtatattagctcatttaatcctcataatagcccatgaggtagatatgactctcatccccattttatatgtaaggaaattgaagcagtaatattaggaaaaagaataaatgatttttaaacagccataattcaaaccctgattgtctagctctagagcccacgcgctttatccctaaactatacaccttctcactctgggcttcacccagtaatagctgcccaattacaggataacaataagaacattttgcttgttttttttttaaagattattcaatcctaaatcataagtattcaagtttctgagtcaaaatttgacattcaaacattcttaattgcaccagcagaccctgagacaatggttcaagagtccgtagtttatttcagaggtggtcccaggaaacgtgtgttaagggagtatgcagtgagacagagaagggccagaagtcaacaaagggtgtgctatcaatcgagttagcactagggaactctagatcagcacagctgaggtgagggatctggggttttatccaccgattcccatcagtcatttgttgagagcttatcccaggggatgtaattcctcacacttctgacctgccccatgctctggccgggcagtctcaggcaaagcatttggaagtcacgtgaatatgcacagaaatggtgaagggatatggatggggtactggctggccatagagatggccacagccagcacgtgaagaaatgtttcaggtactatcgggttttcttgttccaatatgcagtgttcgatccaatcatttaaaaccatgtgtgtttggcaaataaaacaactttttattaatcttctgtccatagtatttattaattcattattttcaaccaaaatttactgtaattgtgaatctaggttgggtgctgggggcaaagattaaaacataaattaaaaacaatctcaagcaagacctacaaattactacccacaaaagcaaagactgataaaacaggctacattaaaataagaccttctgttcatttagagatagcataaggaaagaaaagacaagctaggaaagatatttaaaaatatatataattaactaaggattagtatccagaatattaatattattaatattatttaatattaatatagttaatatattattaactaaagattagtatccagaatatattagtatccagaatacttctaaaataaaacagactacattaaaataagaccttctgttcatttagagatagcataaggaaagaaaatacaaactaggaaagatatttaaaaatatacataattaactaaggattagtatccagaatattaatattattaatattatttaatattaatatagttaatatattattaactaaatattagtatccagaatatattagtatccagaatacttctaaaataaataagactaaaacaaaaactcaatgttaaaataggccatagacataaacaggatttcactaaataggaaacacaaaaggtccacaaacatgtgaaatcaaatgcaaattaaggctgtaatgagatagtattttacatctcctagatgggcaaatagggtaataccaagtggtataaacatgtgaagaatgcagaaactcttgcacattgctgatgtgtgtgtaaattggcacaattacttccaaacaatattgtactatcttgtgctatatccctgacatgccaattccagtcttgtacgtacatactagaagacatgtttgaggctgttcttgtccacattccttatatgaaaaactgcaaacccaaaagacacatccacaagaaaatgaataaataaacggtggtatagtcacaaaatgaaatattatacaacagtgaaaatgaataacatgggtgaatcttggaaacaaaatattgcatgtagaaaagcaagacccaggaaaaaatttctaactcaaaaacaagcaaagccaaacaatatattgtttggtaatacatacataagcaataaaaccattttttaaagtagaagaatgattaaagttcagaggagggcttacttctagagtaaggcagaagaatgaaatagggaaaatgcacatagagagataaaataatttggttgtgttccacttcctgagttaggtagtgagttcacaagtgttcattttatttttatattccattacttctacatatatcatatatgttatgttttatatgtgtatatatatattcttttcaatatatcaagaattgtgtaataaaataataataattaagaaaattttgcttggctgtacacagctcacaatcctgtttggaagccttcttgttgaaatgcgaaatgctttaatagacagagaatcaaaacagaggggttgtggagcccatgctggggccaaggaaggtttcatggaggaagccttgaaagatgagtaaaatttgccaagtggaggtccaagaaaagcattccaggcaggagaaacccaatgagcaagggattgaaggaagatggaagcctgttggcatgtaaggtgctagaagggttggggatggggtgggaggagggagtggggttggggtgggggaagacaacactctaaatagtttgcaattgagtgaattgacaaggtttggattattttatgtcaagttacaattgtcatacttgtaatgagacctgttatcattgcttatctttttagggataaaccatatgccctccaaagcttctgaaggaaacaacttctctttccccttcatattggtgatgttgggagggggagatgagaaattgaacacaactagccccttctctccaccagtttagacagctcaccccagacccaagagtcaagtaatcacctctggatatgaagagatattcatgttgggtggtctaccaaggattaaatgccaggatcattgagaaaatttcatctcattaaaggcacagaggccagctgatcctcctatctgcagagctgacaataccttaggtgcacaattaatttcccaaatagtttaaataatctagaggagcagaaactgcactgacatgaggaatacagataacaatgagtctaataatcctggacattgctctgggcagcctgggtagacacacgtgtagccatttcccaagctggctgatgtgacagctcagcctgagctgagtggacagacagagtccatggccctccaggagaaattcaagccactggtgccttggacagaaccttcatctctaaagcagcgcaaccaagatattcacgtttctgtgctgtatgacaaagattttgtaccaaatgaaaaatgttacaataataataatttctatcaccaaacaatactttgagtgtatatagcaacttaactatttgaatcatacccatttttaaaactctgtaccagtacaagcctgttagcacattcactgacatatactagtaagcatatgtccttttcaccaaacccaagaattctatctttatcaaaaaatagaaagactataggagacagaaaaatgttcattttacatttccttagcaaatctgagatgcacaacatctcaaatctcagataacaccatggtattacgtgcatgtagaaagactttagttgctacaatggacttgtctgcaattatgtcaaatatgcataaaatttttggcagatgggaatatcagaaataaaagatgctttttttagctatgttacacttcttcttctcttcttttttttttttttttaaaaaagggggggtcttgctctgtcacccaggctggagtgcagtggtgcaatctcagtgcactgcaacctccacctctcgggatcaagtgattctcctgccccagcctcctgagtagctgggattacaggcacccaccaccacgcctggctaatgttttgttttgttttgttatgttttgttttgttttgttttgttttgagatggagtctctctctgttgcccaggccggagtgcagtggcacaatctcagctcattgcaacatccacctcacaggtttaagcaattttcctacctcagcctcctgagtagctgggattacaggcacatgccaccacacccagctaatttttgtatttttagtagagacagggtttcaccattttggccaggctggtctcagactcctgacctcaggtgatccacccacctcagcctccaaaagtgctgggattacaggcatgagccaccatatccagccaatttttgtatttttagtagagacggggtttcaccatgttgtccaggctggtctcgaactcctgacctcagatgatctgcctacctcagtctcccaaagtgctgggatcagggtgtaagccaccttgcccaggcttgtgttacacttcttatgagtaacttctatatgccattaaagtatgaattagagagttttaatagtctgcttttattttctagtaagcacagaaaacataagaggttgctagtaacaagataaaaatatccatagtgactaggcaggtaagtatcccaattaggtgggtatactaatgtaatctcttccatgccaggaaaggaagcttcagatgtttcatgtcaaagaatcatatattaaggagattgtagagacaatcaccactaacttttagtggaagaataaagacatcaaaagaggcaaacaggcaaaacaaacaaataagaagagttttctaaaagtgaggctattgcagatgaaggcacagaaacagtttttgtggtctcttttctactactggactcaaggtgccccataactttggaaacaccaccatcgatgaggttttcacatttttttttatctatagtttttgaccctgaatacagaattggtcaaatggagtagtatctttatggccctaatacattgctttgtattacagtcatttgaatggaggtctgtattcttttcaacacttccacagaacctagtccagtgtctaacattcagtaggtgctcagtaactgtctgctgaatttcagtgaataaaccccttgaaagaggagttattccaccacagcatcaaaaaaaaaattcacaatgagtttataaagattatgttttctactcataatatttgaaagtatctaccagaactgggatttctctccttccaatctgctttgaaatttcttggtatcccatggaaaagaatatattgctaatggaaattccagtggggtctcttccctgtgagcaggctccttgactctcttccaaatgccaccatcaaagattccattcatgcccctcacattaggtcccttcattaccctcactcagtcataaaatatttatggtgtaactattgtggtgtttaaggcgctgcactactctctgtggggggaagggaagggggaagaaatgtagccccaatctacccccagacctattgtgacctatgaaataggtttgcattaaatacccatgtttatattgtaatatctttgcccatcttaggaaccaatcacagtgttaagaagcagggaaacaaaacaaaaaacagaatgccttctctatctgccctcaaatagttaaggctttaacctgtcttctgttcccatcattccatgaaaagcccttctctgactttgccaacagcctccatcttatccaatcccatggcatttattttattcttcattatcctgtttgaacaggctcatctcctgtcaatactcttccgctgtttcccactgacagtgctgggtctgatgcttgctgtgctcatctgaaaacacagcagaggtcagtttgggctttcattttagcaatcgctccctgaggagcagagggaaaagtccagctactctgaacaactgcttcagttctctctgaggacagaagaggactctcagcactagacagttagctctggctcctccactctcttgaggtctgtgagcccttttcacatcaaatcccactaaatagagaatttcttataatccccatattttcatccccaaactcactctttcataagtttctcgtaactgcatctcagggctctttcttcgtactgatagcagataactttggaaacatatttaagttatcctttgccctgtctttcctaccgtctacttccaaatctttttcagagttcctgaagtatcattttgatcttgttgcccttactcccaaatcttatgaggactctcagttctcacatcaaggaagatacctgaaagcctttaccagatgtgtcacaacatagcccatccttctcgtcacagatttctagacactccccatcaaattttcatgagcaacactgatatggtttggctgtgtccccacccaaatctccacttgaattctatctcccagaattcccacgcattgtccgagaaacccatggggaggtaattgaatcatgggggctggtccttcccgtgttattctcgtgatagtgaataagtctcatgagatctgatgggtttatcaggggtttccgtttttgcctcttcctcattttctcttgctgccaccatgtaagaagtgcctttcaccccccgccatgattctgaggtctccccagtcatgtggaactgtaagctcaattaaacctttttttcttcccagtctcgggtatgtctttatcagcagcatgaaaacaagtaaattggtaccagtagagtggggtgttgctgaaaagatacccgatgactttggaactgggtaacaggcagagattggaacagtttggagggctcagaagaagacaggacaatgtgggaaagcttggaacctcttagagacttgttgaatggctttgataaaaatgctgatagtgatatgaacagtaagatccagactgaggtggtctcagatggagatgaggaacttgttggaaactggagcaaaggtgactcttactatgttttagcaaagagactggaggcattttgcccctgccctagagatctgtggaactttgaacttgagagagatgatttagggtatctggcagaagaaatttctaagcagaaaagcattcaagaggtgacttgggtactgttaaaagcattccattttaaaaggtaaacagagcataaaagttcagaaaatttgcagcctgatgatgcagtagaaaagaaaaacccattttttgaggagaaactgaagccaactgcagaaatttgcataagtaggaagaccatggggaaaatgtaaccaggccatgtcagagaccttcatggcagcccctcccatcacaggcctggaggctcaggaggaaaaagtggttttgtgggtgggcccagggtccccatgctgtttgtagtctaggaatttggtgccctgtgtccaagccactccagccatggctgaaaggaacaaacatagagcttgggctgtggcttcagagggtggaagccccaaatcttggcagcttccaagtggcattgagcctgtgagtacacagaagttacgaattgaggtttgggaacctctgcctagattttagaagacgtatggaaatgcctggatgcccaggcaaaagtttgctgcagggacggggccctcatggagaacctctgccagggcagtgcagtagggaaatgtggggtcacagcccccacacagagtccctaccgggacactttctagtggagctgtgagaaggggaccaccatcctccagaccccagaatggtagatccaccgacagcttgccctgtgcacctggaaaagctgcagacaatcagtgccagcccataaaagcagtcaagagagaggctctaccctgcaaagccacaggggcagagctgcccaagaccatgggaaccccctcttgcatcagtgtaacctggatgtgagacctggattcaaaggagatcattttggagctttaaatttgactaccccactggattttggacttgcatgggccctgtaacccctttgttttggccagtttctcccatttggaatggctgtatttacctaatacctgtacccccattgtagctaggaagcaactaggttgtttttgattttacaggctcataggtggaagggagttgccttgtttcagatgagactttggactgtggacttttgagttaatgctgaaattagttaagacattgggggaccattgagaaggcatgattggttttgaaatgtgaggacatgagatttggaggggccatgggtggaatgatatggtttggctgtgtccccacccaactctcaacttgaattgtatctcttagaattcccacgtgttgtgggagggaaccagggggaggtaattgaatcatgggggccagtctttcccttgctactctcatgatagtgactatgtctcacgagatctgatgggtttatcaggagtttccgcttttgcttcttcctcattttctcttgccacttgccctgccatgattctgaggcttccccagccatgtggaactgtaagtccaattaaacctttttttcttcctagtctcagatatgtctttatcagcagcataaaaccgaactaatacagacactctccacgctacacaaataagcctggtcttccacagagccaccttgccctgagtttacatcatagaacttgctaagctaccctccctttcctgataattaagtgggtagtagttatgtgtgttgtgcgttatctttatctacctttattatcttaaatcccacacctgcacccactgtgaggtcactattactgttttttcagttaaggaaataaagactgagagagcttctcatgatcatatacctggtgtcagaaccaagatttgaacccaagtctgcctgattcaaaagcccatgctcctaatgactatgcagtgctactgccctcatccctatcaggatggcttgttcagggggtgcaccaagctttaggcactccctgcacatgccattgtggttcactaagtggaaaattaattaacagttactgaattttcagttatttttttcagtataattttgtcaacaaataaatacttacaggtctaagaattttttatgttatgaaaagggatcctcattgtaaaatattgaaatccaactccttcattttatctacaatctagaagattctacattagttcaagtcgtcctcatccttgagatgtaaaagaaattgctctgaaccacccaatttcttgaccccttgtgaagatgtctacaattcccaagggtggaagaattaagtcttattggtgccctctgccacccatgccctagagttctcctgctccacctccatcttctcctataaaaatgcaccttctcattcagtagctagaaggtggccaggcaaagcaggcattttgtaaattttagttgactgggggagggaacagatgaataatgcaggatgtgaggctttgtaggttaagatcacaagaagaggtggatggttatctactatctccccccaccaagaacttttctgactctgagtttgagatgtccaaagaaaggcagaatcatacctttctcattgattcttatgtttacaaagtacctttataaagcgtctactgtgttccaggtaccatgttaatttctagaagtaaaaatgtcaactctgtcactgtcttcaaggaatccatagtgggaagcagagcacacaaacagatgtttacagcacaacatgatgagtggtttattacacacaaagtattcaggaaacaactaagaggaagaaaaaccatctccacctggaaagactggaaaggctacacaccagagctcaaatttgaaatacatctcgaacaaggatttggccatgccaagacagttgagtggaaggaagtacattctaggcaaagaaaaagcacaaatgtgacctacaaatgaaagattggtgagtaactctgcatagctggaatataggcataaaagagaaggcaagaaatgaagctgaaatggtaagtcagaagtgtattatttaaacccttgtttgtggtgctaaatggctgggcaactaggagtcatggtgtgatcagatctgtagtttggaaattcaactggaaactgctatggatgagagctaggagaggggagaaattagaagctattatagtgatgatggcaaccaatggtgaggtgatctttaggtcatcactggaacctgacctatagtagacattcaaaaaatattttcatgtaattgaatttgtctcatgagctccttgatctaatatactgagcaactagccttgctaccatatcttgtaaaatgccactcgtgttatacgttgtgggaatgcttaggtgcctgaccaggattttaagaagatatagaactaacttagtatttatttataggtcgcccatcacatgctaagcatcttctatacattatctcatttgtgccacacaacaatccttcaagacagtgttttcaccattttacacaggagtaaaatgatgttcagagtaactaataaacaaatttatccaactaggggtaaagccagatttttaattcagtgtacatctaacttcaaaggcacctgtaaatttgggatattatggcaagagaggtactggtaaagccacattatctttaatcaaatattttagaatagcatccacaggagtgtgcatgtgagacccctggcctgggaagaggagtttgcatcctgatttcctttttcactgcatatggcagcaaaccataatgagtcagacattgtcataacacattgcataattccaatgaagcattcacatctcaactactcttgattatttccaattccgtaataaatgaaagagatcaactgttcggtggtttgaggagggtggaaaatcatttaattcttaagtaccattaaatatttaatactattataaggaggtaatgtcactttccataatacatttggcttcaggtacactggaatccagattttgacacctccataccatgataaatttttgaccctgaaattttatttgaaatcacgactccaaaatctcctgtagccaatctaccaggagtagtatctgtcaacagagagaacatcatataaagaccttaacattttgaaagcaaagccaaatgaagctcaatcacgaaaggtcttttctttctttaaggtgagagatggagcacaaatgaagcataccatggtaaataggaactgtgctcacttgcagtcatgcactatagccattaagccttaaggtcttaaggtactaagcaatgcatatgataaatttctcaaaaacatcccagccataacatagttcttgctgattgctcatttacccataatgcatgctgtcatagcaaagcctgacaaatgacagagaaagctcaggttattttttacactgactgccaagcccctcacctcagattattcatttattagggcaatcactgaggtctgggtacttaatattgttttcaccaaatatgaaaatgatctacttgcctattctttagttcctcctagggcaagccatttatcatcagctcaggataaatgactgcttcattatagctataatttatgaggtgttagaagtaaagagccacgcctagagacttaaagctttaatatggattaaaataagataatcaatcaagctaatacaaattttccctcagcattatttcttgttttgaaatagcttaataatttggtgaggtggcggtaagctatgttgaatatcccattatccaactacatgcatgtatgtctgagacaatacgtaaagaaatataggatgtgataccatcggaaaaaaagaaatacaatgaaaccatcagctgtaattggctgaaatcctcactttccttaatggtgtcaaactggagaccaaagaattacaaagcaggtgtaaacttgggtagcatattccctctaattctttttcctctgtaagaatattgtagaaagattgctgctgttttacttttccttattctctctacaacaaagaaacactggggagaaaagttatgtcccaataacatgtcaacaattttgctttcttttatgtctgaaggtttcacaactcataatttggacaagagcagcttcttactctgtctagggaataaagaatatttccctctaaaatggcattacggactttaaagaaattttttctggtttgcatctcaattttatagttattaggctatgccagaacaaatattatttctgaaatatgtgtcatgctcaagacactaacgtaaacctatttggccacttgagtgaaaagctttgaagactgtacgggaaattcacgatttagtactttaaacacacagcaccaggaagaaaatcaccacaagaattaacaaatcagcagtctaaagccaaagactccaaggtgctaattaaaaaagcttccaaaagttcttgttattttttttaaggccatgttccttgcaggtgagacaaataggcccctgctgcctccaagcaaatcttgaaggaaacttccagcaaggcctggtgactggaaactactcagccttgaaattaacatccctaagaaaaaccttttccactccctctagacaacagcagcttacatcttcaggacaaaacgaaaaaaaaaaaatgatgacaaaaaagaggccagagaagacagttggagtagtcacgctgtgttctcttgaagggagccttcattctttacctcagagagagagcgtgaaaacacacagatcctgacaatggatttagtcaacgtggccaatctccctacttccttacacgtacataccactgagtttaccttaaaaaagtaaaagcagaaattttcacaaaagctgtgcatcaggagctgttattacaaatgaggccaaggctctgcataagaagaaaaggatctttcacaagttcataatgggaaccgaatgcaaaagccatataattataatccagaatatggcatcctatgatataaaatatttccacttagcttaactgttttccattcaatattatttccagcaataaaagcctctggaatatcactcaaactggttcaagttaaattccaatctagatctttgttagctaaaggacatttttttaatccagtcatctttctccaccctacacataattcaacaacagcccttcaacagggataaaacaatttaagctctgaagttgttctatgcatgtgtgtgtgagattttcatgccctatgtatttggactgaaaatacttctctctgtctctctctcatttagactttatttaagatggtgaaaaaaaaaaaagcaaaatgtgatattcacaagtgcgcagcatcttatttcccatttaaaaagtattctgtaaagaaaagtcttatacataaaaagaactctacttgtaaaaatgaataggaatatgtactatgaaaatattaaccatcttagctgtgaagaggttccagtggttataaagagaagggaaagtagatagaaagctctggcttggctgttgggtttttggtttgcttgttacatgtttacctgtttgtttaacactacatatatctccaggtactccaccatccatgtcatcaactgtggaaaaatgtcccattctttcttatgcctatttcttagaagttccagatagtgagggaaaatattctaggtctcaatgagcaatgttataaattatattttgtatgctacactttagagagatgtctttagtgtattataccattgatgattcttgtgatttttatttctatgtaaaatacagtttacacaaaatttctatcgcttagtgagacattcataattacatatgaataagaattacagaagacattaaaatgttttcataatagatgtggaaaaaagctatcctgcgagcatgtttaaaatagacatggtttgccttaaactgaggcataaagccccactgctaactgataatttaaagcacaaagatggggaactgtttttctccttacttctgcttgtctgtttatctgatgaaatgttcaaataattcctcttctcaaaatactagtctctagtaatgcttttttatatatgtgatccctcaaggtagtccttcccaaataatagccatcgatttttaaaaaaactttgaatggatcaaatcttccaatagacatcaatcaatattctcagatgctttggtaagccgggtcatcactactcacggccgatgcccaactacagcttggtagactggcagagcaaagctgatttctttgaaaggccaagtgatagaggtcaagcttgagactgcttaggaaacacacgcctttcccttatttgtaggacaaaaatgattgttaaaaatttttaaattaaataagttaacattttaaaaattaaataagttaacatatgggaaatccattggtaaactgaaatgcactacataaatctatgatggatcaatgttgatattattatttctgttaattatattatgcatcttccttcatgagtcagtcagaatttagaagatatttacattgtattggaatttgttgattcagttctaggaatacaaactcagcatctaccacgtaaaggaacacagtactagacacaaaggggatgtgtatcatggatgtcaagtccctgctttctagtagctcacagtttcaaacaactaaaatgcagttctgcgccggcttcagaggggccaggtttcccacaaggcctggaattgaccaatagctgagcacacatacttgccatatatttcttgaatgagtgagtgaatgaatgaatacctaatttggctaaccctgggtatcatccttattttcatcatctactaaaaattagagttgaatatttctatttttctgtaaggtttgaaaataacaaaaaattattttcaataagctaggcatgagaaaaagcaatggcagctacatatttttccatagctttcattccctaatcacttcttgcatagttatacacagaactttaactgctggctttttaagggaaatttctcaaatgcaaacaaatatatttcaccaaataaaatccttacatgaatggaatgggaaatagtaacttagatgtaaactgctaagttaccaattagcttcttaaaacaattgaaagtcacagagagccctcaatatacagaggtggttaattaattaacattagatgtgattaataatgagtctcatttaatagcaaatatctgcctgcaatggctgcatgacagaacaaaaagccttcagagagcaagcaactatatttatcctgattgtgtttgggattttaacatgttttgtgcaggctgacaaatggcctattaattatctaatgttgtctgacaacaacagcttgataaagatgtatgtttttgaatcgctggatggaaactgctggagaagagccccagaggggccttgctgtcctaaaactgggctcctagccacaatgacagtcaagacaaagccctatctcccgccacagccttcgcagataaaatatggcttggcattagggacatttttttctttcagaaaactgcttctgcaatatctgattaggaaaaggaggagtacttctttactaaattggggttaaggcataatcaatatcatatatggagtgtctggcctattctgcataaacacgggcacttcatattattaaggagtctataatgccgaggaagcatatggcaggacactgcagctgtctctattctttttatttagaagtttatcttccaacctgtttgacagctgctcctaagtggtttcacagtgccaaactatttttatgattgtttgatgttttattctcccatttcagttaatgagataggatcccacaatggccataattcagggctgtcagaactaaaaagcatgcttgtggcaagagagcctgatggtaaataaggctaaaagcaatggataataaaaaaaaaactctgttatcagagtcgcctttgcaatcaaaacttgttggggtcagagccttcctttctttgtgtggcttctggatattcccagccctgtgcaaggtccctgtccaccctcctccatcacccatttcgattctacaaacaagtcctcatttctttggaaaggctcatgaggaataatattaactaagaaatgttagaaggtcttaaagatatcgagtgctatattctaattaaagggcttgtgcatcatttacagtgccaagcgagtaatttgtcatacactgttacagagaaattgttcaacaaataacctttacaagagtcttgagaacagcttcataattgaaatccctaatggttttgctgggaacttttattaaggtttggaggatttttttcttttcctctccctgaagagtttttagaaacttatgatggtaatgtagcaactttctttcaggaaaaaaaaaaaaaaaaaaagccctttcttagttatatttacaaatgccgtaagtattcacaaggccatttctgctaagaatcaaaagtacagtgttttccagaagaaaatgtgaggtttgctttgtgtcttttattttgtttttattattcctaatggagaaagttttaagacagatgaagatacctacctttagaattatttttatcttacactaaagttcatgatctttattttggtgtaacactatccttgaaaatgtaatttaaaaaaattcaaagtcactactagattgagtctgtcacataaattattattcaaaagtttaaaaactgaaaagtgaccactttctcaaacaatatttctcttcttattacacatttaaaataatggtccttcacaggcagaaaatagcatggcaaaaaactcaaataataataagtcccataactaattataaagcctgacacgcctcatacagaaacactccctgatgactaccaaagattggctgctttataaatatttaatgcttgccagtaaccccaatttttatctcacatctaagactaaaccatttgtctcctcttacaatcagccatgtctatgtagtgtcatcatgtctgagcaagtttgacttactacgtgttttccaggatataaaattcaggacatgacacatcatcatgtgaatgaaacaattacacaatctaagaaggatggggaaaaaaagaattcaaataggctaagtgtcattataaggttagctccagagaactcaagtcagaaaaactgaacatcagaaaatgatagataggtatggatctgttgtgaactactgaagatgcagctcttataatactcttctgtgaccctcaattcttttctgcaaccaaataaagttatatgaagaaagtgcacaccctaatttagggatatttatatccatataaaataaagtgtatctccgcgtttatactgcgccacctttggggaaaagtgtagtagtctctaatcagggctggtgatggcacctgaatcaagagaaaaactttgacagttgaacaagtggttcctattaaagggatcatagaagttaaaaggtaaagattactactctctgattgatgggttatcacctcctttggattatcctataaaccccattatttctatgagaatgactctcataattccggaatattttacaggtgagtacagccacctcaaaaactggaaacatgtttcacaacttccagaacagtaaacatgtgaacaaacccaactacaagccatgcatggagcaaatacctttgagagagctcatataacctgccagtgctcaatgcacagccccttccaccagtcttatatatgaaactcaggatcctatgtccagagctctgagacaccagccacttccaaaccaccattggaattggtttggtttgtccatcatgaatgttgctcttattggtttgacgtggctgctgtttgtgaatgtagttcttatgtgtttgctggtagaaagcttttgagcctagtccaagccagaggctgcgaactaggcagtctttggcctgcaaaagttatcatttcattatcagtgtttcttttccttttaaaaaaattattttacttgtcaacacttaaaagtgagaggatttttacattaatttaaaaaatcagatttccaccttcttggaaatttatatggtctggcaacatgggatccacattctgggaagaaaaaaaaattctagagccctaaagacatgatatccattcttgggttccctgtgacccaccactacatgagtcttttccttcattcacacctgggtcctgctcttgcttttaaataacacccaaattctagtccacacctgctccttgcattgtacaatatagagatggggggatttcagtgaaagtgatcattgtcacgaaattcatttgcagcagaagtgggtttagattccagaccccctagttgacaaatcaaggcaattaatcattatatattcaccaagtcagtaacagtatattttcaaggggcttggaacctagtgggaaataagggatgcatttgtaaacaacaataatatggtaaatggctgaaaagttactcttgccatgagaaaagaaaatataaagtgccatggactgtcagcatccatgtcaactgggagctggttgcaaatgcagaattccaaacccaccacggacctgctgaatcagagtctgcattttaacaagcccactccacgattcaaattccctgtcctaggggagggactttgcaccattccagaggtgctttccatcatcccctccgtaaaggtgggaccacatagctgcatggttatctgcgacccctgtacccaccataatactacgcactgaaagtttaaccagtattagtaataaacaaactactaaattaggattcttccctccacccataggaggaagaacacacacatgttctcgccgggtgtgcttttctaatgtgaaaaccaaggactgaaaccagaagaaccactggaagcaggcaggaggccctgatgtgaggcaggtcagtggcaggatgtataagaggaaagtacatccagggagctgggctggctgccgtctcagcagccagacccagggccagttgttactcattgccatccaatccctccaacctcatcgttctccagctctgttcacagctctaccactgttctccacagctaaaaccagctcccctgctggggccctgccatgtgtttgacagtcccttccaagcaccccttccccgagcagaagggccagaatcttcactaattaatatagcccatggatggggcagcgcttaggagaggctactcattgttgagataccctagatgatttttttcttttaatttaggaactcacagggcttaattttgagctacaattgtttggtcgggctctctgttcagaaactcggccaaaggattaagcattagctccaggagtgcagataaaatgattaagtaaattagtatagtacttaaagggagaagagacatcctttagaatatataggggaagagaggacagtcacctaaaaattattcactcttcttatctgatcatatcaggccaacttttatgtgtgctaagaaacagaacatacataaaagacaaatagaagaaaaaaatgaaccacaatcttcttttaggctccataactgtattttgaggataaaattgagactatcatcttaaatggaatctctgatattcatgtttgaataatagatattcccaattattactaaaaatgtcacctctgaaatatgagggccacatacctgtaatgccatcagtcttccaggccctcactgaggatttgggtttctttttttgttttgttttcccttatcttttcttccccttggaataggagcaaatgtgtctgtattgttcaaaagcatacacgaaaatgtgatgtaacctaagctaggttttcaggtgttcctttttctaagcacgaggaaagaaaatagatgacaccacaggtttaatactaattgatttattacctgcctaagcaaatcccaagctgcgcaatggcaggcttggacttaaagcaaatgatttacaagataatgtttgactctgggaaagggtaatcagatccagatacaatggatgataggataattgagaagaaataaaagaggataaattgccatgtgctaatgagtttacaggccttaatgggaaggacatcagttttaacactcaggttatgagctaggagcaagtctttttcttttccacccccgccttcaactgctaaagatgtagtgctgaaacaaaccaagattaatggtatcccactcatttacttaaccattctttacacctcagaaagcttcctgcattaagcatatatagctgtggtgtcctgtattaaacacagagagctgtggtgcttattttttaaaaccaactttattccaagcagttcctgtcagcagatgccacttatccaacagcgccgagatataaatgtttttggctgggccacttgagcaacaactcttctgctcccgagtccctgggggccttggagcctgatgagttgatgccgttatctgcaagccttttggcctaacggagaatattccgaaccatttatgcaacctgggtgcactcacatttagaaatggttgcctgagcagcaatcatgtcttgcctcatgattcatttttatatctcactcacccgccatcccacatcaccagcgaggactggtgacactttattggtattttttgattactgctatagccatctaaatttttcacaggatgggggcctctggtccaaatgtagccgcacactggactaagggtagaggctacaaagaaataaaggggcagaggccagcagggcgattaggaagtaatgtagagcagaggcacttcctaggaaacagagaacctattcccttgtaatgtttctaccaaatgaagtttaatatgatgaatcatggtgcagctccagcatgttcacaccttgcaaaaaagcagctcaagcgcagcatttaaacatgtctgaatgatgactcgattcccttacacaaaagccgaaggagtacatatccaaaatggctatttctacctgtattgggaaggttgttttagagcgtttcccattttcacatgtgcttgggaaatccaagtgctcatttcatgcttactgatgtaatcctgatcaaatagtactcttattcacaaaagctgatctgatgttatagttggatcctaaaccgtaaacctcaaacataattattttcttgacctggtgttttgtgcagtgaggttctagggattgatttgaaatttacaacctgactatttctgagtcaagcagttactatgaaactataagcaatattatttacccactccatacatgagatttttaggaacatctgggttgtttcaagtttctgacaatagtaaaacttcactggttcatgttaatttggagaaatcactaaaacaatattaagtttgtcacactttctttacactttaccaagtgtttttacctgaaaagttgaccagataatataggaagtttgcttttagttttcaattattactgaaaatatctgcagtaatgcaggacaatttgctcagcctaagctgtagctaagattcattttaatttaaatgataactgtttatatagaagtagatgcttccaacaaaatcatcaggcttgtattcccccttccccctcaacctgtcccctgctccaaatcctacatttgcttatctttcaacttgatttactaatactttacatagcaaacctgtttcaggtgtataagggtcacctgcagttcaagccaggcccattttggttggattcttatagtttctgaattaggcctgtgatgctctaccctatactacttgtgcaaaagcatctggtgctaggcagtggagaagcacccgagactggcgttagtatacaccccgaaagactaaagttaatcttcttaactctttaggctgctgtaatccttttccaaaatgtttaagaataggttttccctgtggtaaagaagtaagagcccaatttctcaggcagataaactgagtcttgagagttgttttgtggcttctgaaggtcacaaaaggagcagaaaagctgggaaccaggcctgggatctcagactcccacgtcctcactgggaacactagacaatactgacaccctccatgaactgaatccaaaaattgtaaaagataagttgtttccttatattgttcaaagaggaaaaaaaagaatagctttcccacagagagcaaacaaatagtgaatgggccctctcttcatcctatagaactctatgtgagaatatttttttttcttatgtgaattcttaaaaagtcagtttggattgctgcctaacttacagaacatttcagaacagacctattttttgtctaaacaatagaagtattgggtcatagaatttagagttggaaaagaccttagagatcatagaattcagcaccctcattttacaaactgagaatcagaaagattagatggcatggacatgtttacaagtcatttataacagaggcaattaaatacatttcaaggaaaataaatctatttgtatgaatgttctaattattctaggaaaaaagtacaagaatacgttatctgaaacacatttattattttacatggcaagacttggcttcttcccttcagaacaaatctcgctgagagtggattcagtctccttgcaagaaattggacaagtaccaacaaggcccccattagccctgtccattacaggttccatagactcaggttttgtcaagagtgcaaagaggaaatggcagtgtgatagcaaagcatggtgccacacaaggattaaataagaaaagggccaaaaacatccacaaaggggaaccaattaatttacgggagagtccaagatatatgggagatcatgttccagattcaggtatcagttggccagggcctttttggaaaataatccttatcttttatttggtgccctccttgccttcctgttccttctcagccagtaaatctgcagccttaaacaccagctcctagagaaaaccaatgttttctttttttttctaaaacagacaagcagttgtatcaaggatcttctcccaagaacagggtgtattgatattggacacaacagttcagttctgctagagttgaatcttccacttgcgccacccctactctcttattttcgtacttcatctattttctaaattagttgaaagattagctgtaaaatgatcagcttctaaatgattgaagctgtggtcttatctgactcatcatctgggacagaaaccatggtgcagatggatgttcaaacagaaagacatttttacataaaaaagttgtcaacaaacaccaggctagtgttattgcccagaggaagctgacatcatggcaaagttttgaagaactctagaattttaggactgcaaagacatctgtgcctccgcttatacagaatctttatttttcaaatatgaaaaatttaagttttcagagatttggtgaaggtcatttagccaataaatagcaatgaaagacccaggcttcttggttcccactgtaccacatttccagcagttctgaaccagctcacacaggtctaaaaaaacaacaatagaacaacacaaactattgctctccatttttgaaaaaataaatttttggaagtggtaagttatagacgcatataagttaatcacagctgcctgtgtgtgcaaaagtagcagtagcaaaacacctagctgataaagtagttctttaacctttatagaaagcatgatttaaggcatcttatgggaaatcaaaggcttcagccaattccaaggatcttacagaccaatgggagcagtaggaaccctggtgagatggtttcatgccatgctttttaagtttacatttagtcaccaaaaaataataggctgatatttttgaagaagagctaccttctttcttcatctttgttatataactttgttatccctttccaaattcactatccaaatattcgctagtgtatttccaaatacactagcgtgtaactgggctctcaatcgccaaaccctggtggcattccaaagtgtaaattttagacacctctgagcagattttccatgaacctagagatccagtgagagacaaattctaccaacaactcaatcctctagccagtgaaggtagccccagcagacagcagggaaagcctatactctcaatcaaaggtaacagctcaacatgccagagttcaagcattatatagatgtaatattattcttacaccaaaagactaagctgttgatgagaaaattgcacacatgctgaatgatgggcttaatgtcagacagccagatgtttttacttagggctctttcccatctttgccagcaggcaggagagaaaaaagaagacaacaatgttctagattaggagctctctgagagcaaggagtgagaagttttgcttttacaacattaatctttagtgtatactacattcctggcaaaaattagatgtcccatatgtgtttcttgaattcatatgttagcactcaaatcagttaattttctatttagcttaatggaaaaaaatgaagacttgaaatttttatgctgttaaatttacttatctgtatcacactggaaaacatccttacgaaaaactggaaacagtcttggataggggcttggggttttttctttcaaactcaacaagtaactctgttgccattaatgaatactgtaaaggtagtctttatttgtaaatgtatatgccaaaggcaaatatagtctatattctaggatttacagaataattattttgaaaatttcttaaaaacaaaattttcttgtgtctaaattatttgttcatgaaactttgtaaaacatgcaaattttaaagaacaacctcatgtaagaaacataaaggctaatttttatttaccaaataagaagctgtttttcaaagcccagttcaataggacaaaaagttttcctgttggcaagcataaaaactcattttcagcatttaagctaatgaagcacttggacaaatgctcagttcaagatatttcatggacagtgtgggcacacatttatatgtctgtgagcatacaaaataacacacacatgtaattttacaatgcaagttaagtataaggaaatggactccctttcccaggcaccgggcattaaaaaagaaaccaccccactgggaaatggaaggattaagcagagattcctatatggcatcattcatcttgcacagatattagcttgatgctcatgtgaaaacataaaaactccatctgttccctaggcatacttagtttgttgttcagatggtttgttttaaagactaatttgtaatggttaagttagttatttcaactgaaaaaaagtgtacaaaatggagcttggcatctggttttgctaaaggtgttaagcaatatttaagcagctgagtgtcatctctacttaaaggataaaatgaacaagggaggtggattctgcctccagatagatgagcttcaatcagtatgaatgggaacagaataaaaataagaaaattattatattttaaactctaaggtcatcctcaaatgtatttgaacttttcatttagatgatgtagccatatgagaaattctgtgtaacttgttctactttgatagtaaaaccttaaatatttacatgtatcaagttatacgtttaatttttttcatttctccaattgccattggatttgggagtaattgggagagtgcaataagatggcctttgtttcctcttaaatggtaatttgcaccttcactgtcatggtgtcagatatcaagtgcagatgcctatcatatttttatcaaatataattttgttaggagaactaaaagtacgactgcaaaaaaattttttttaattcacctatttttcttcaagggatatgtgcccttgactaatgaaggttcctccttaatctgcgaagtttctgcaaagcttgctgagagacacccacagagtggaaaccaggcagaagagaagactcacatgcccacctcaccggccaaagaacccttgagagcaacagcacaacggatgtcagagccaggacatccaaggtaatgatgctattcctattatcacctgagacaacatttgtgtgaggattcttgcatatggccatattaaagatttacatttggagttttgctaacatttccaaagcagttgagacacggaacatttttgttttgaaagcatttcaaaacagttgtctgttaaattttggaatgtaaaaatgtagttacacttggcatgggcatttaaatgtaaaacatatctctgtgatccttttcataacagcaagattctttgttggattggaaacaaaagaaaatctcaaaacactatccaaaaaatcttccttgttgtccatcaggatgtctcgccgtgtagatctcacaccctctagttttcgaaaagcaccacggaccctcattcattgcttattacttttattcactctcattctacctgctttttctaattctcactggatttgaaaaagcaaattaggagggcattacatggggaaaagtggggaaagttcttcaggaaactgatggattactgtatattattcatttaaatctattgagctttatggtcatatgtatccctttaaacggtatttttcttctatatcaatttataatacagtataacttccctctgtatacagctatcccaattcaggtgagaagaagagcaactccaccattgttcatggtcataatcatcagatctttgtctttgttgagaatacaaaattcaaattttctttcttctactaagaaattaaattaaacattaaatagtaaatttttagtgtttactgattttctctccttactgtcactgtgtcaggctccaaatatcaagccaaatatatttaatatttaaaatgttgaaaatgtttcctcaattcacctcttttttatgtggaagaattttttcttttaaaaatcttacaatgaatacttatattagaatcagaataaaaacaaaattcttattactaacaaatttctcaatttaagctcttttcacctatatattcgtactttatttaagttccctctgatgttttaagttcttcattcttaagacagccttgtttaaaggttaagagcatgaattctggggctgaactgcctgggttttaatctcagctttgtcactaattagccgtgtgcccttgggcaagttacttaacctctctgtgctttttgcacatttgtaaaactgggataataatatctgtttcctagtattgttatttaattgttatttcatattcctagtattgttatttaatatgtataaagtgctcagaatagtggctggcacacagtaagttctctataagtattcattatataaataaaataaaataaaaaccttaaagacagccattgattaaattccatttggacaaagccagataaatggccaacactttgcttgtcttagattatcatcaaaatgtgatctctctcattttacactgattttttctgtatgtgtcgacatccattttaacataatgacatcacttcatttcactttggcctcagctgttaacagagctattgaacacttggtgtagattaatttatctttcacattttaatatgactttctcaccataagaaaatcctcatgatatactaaacaattttatttctagaaaattcaatcttggagataagtgattacttctaagaatatccataaaaattacaagctcaattacaactcatctgctgttttaaatgttttcttcttttgctcaattacagttcttctgggctttagctcataatattctgaatataaactctacattttacctgatccttttctaacaagagttcttcaaacactatgctacttaggaaccatgatgaagtcatggtgtaaaaatcacatgtccttacaaactcacatctttaaaacttgtatgtctactttactttgattctaaagttgtattttgttgccatctgaacacttgagatataacatttgaagaatcaaggtataaaaccagagtgagtagaatccctggccatccgttactattgctgggttaggaatccatcagtccaacaggcagcctctcaaaacccaaacactggatatgcatatgccaaatggacttcagctgaataaagtgaatactgatgttggtatttagaagcaggtccttctcaaagaagccttggtacacacctttgacccttaactggggtgctccaacattgcctgtgatgatgactcccagtgaaggctctgcgctgtgcttggctgcatttctatctgagtgccaacagcaagataaatgaaagactggttcactggagtactggtggtttgggggctattgatttttggtccattctctttaaaagtgagatctaaaaagttgacagagggtcattaatttcatcatatacttgtcgtctcatccataaccaatccagagtctgagtgtgcttgtcactctgtgtttgcactttatttgtttggggttttcttggtgattccactcttttttttcctctttcacttcggcctctttaaataaagaaagaaaagaaacatgccagtttgtggctctttcctgaaaatgatttggggatggggaaagttatagatacagatacatagagagagattctggtaataggaaacagtcagaaaatagcctcttccagctgccttctaacctgggtttaaaaaaagaaaaactccatataaaattcatcaatcctaattattcaattagcctccaattgaataaacacttacttaggtgaactagtggacttgttttaatgaaatattaaaatacaagttgccaacattctttttcaaaaagcttctgggttctcaacaaatgttgttgaaatgtacaaaaataattgatagtaatcgttaattgagtttctttggctgtaaattcagaacaggtctaccaatcctgcaagaaacaccaaactgaatttcaagatatcgtgaaaacaacttactggtgagttttattgttatgatggcaggtttatttcttgtttgttttttaacagggtaaggagagtttggcagcctccataattattattgaaataaccatcaaataaaatctttaagcctggttgaattttcaatgagctgtgtaaatctggggtgtggaaaacaatagcacagggcaagagtagaattccagaaaaataagcagagatttttagacaattcttcagcagtccacctagacagttatgtcctcctacctgactggggatgtagttgattctatagtatctgttttgaaacctagttgcaagactgcaagtgaggaaagcaaaggaaaatatgattaagttcacgggccaaggcaaggaaatccagtattaataatatcacaacctgccagtaaatctctattttataggtgaagaaatacatttctactttaagtgtgtttttatatacccttgagtgtccaactagttaaactaccaagggagctctacatgatttagaaattaatccttcaaatagctaacaattgaatgcctcagctgtttgtagtctcctaccgctggctaatttcatttttgttttatatgttcagtggtaagctttcattgttcgctgacactgaggttgtaagtctagttaatttagttaaaatgaggctgagaatgttcatagcttttcaccggctacaacaagacctgggaaaacttggagtgaacaccccacaatgaaactcaataggaaagaaaattgagatgacccagctcatggtcagctttcatcaccatggaatagggatgtaaataaacatctttaaatgtgttaaaaggcttctaagatctgaaaacgtttggtgctttgcattatctcaggctctgtggttacttttctggccaactcccttctcctctttttatgtcaagtcattttcccccaaagccattgcttgaagttgcggtaaaagacaaacctaacagtcttcgtgtgcttcttactaacaaaacccactaattttttttttcatctgcctatcacctgctctgtttcctcccactctcccagggttccctacacttttccttttagctgctcaaaggtgtaaatctccttcccatgccctgattcctcatttcccttccccagataactcctgccccttcctttatttcaacatacccatcccttatacaagttatttttctaactcttcatacaagatctgctccactggtctcatgttctctcttttatgtgtacaaacacgtacttaattcttcacagcactaatcagggctgtaattaaacaattaattgtgtaattaatttttagggtctgtctttcccattaaaatgtaagctctgtgtagattgggaccatatttgtcttatttactttcccgtgcctcagagcctagctcatagtatacactcaaaattttgttgaatgaatgaatccattccaggatcagttttctcacctgcaaaatgtaataaaaaggaatccttgcttctcaatgtcattgttagtatcaaatgatataacaaatatttgaaaaatactttataggaaatcaaatgctataagcattattgttaatgcattatcattaatgcataatggtagcaattgttgtaaccatttctgacacatggaagcaattgcttgaaaggaatttgtcaaatgacaaccactctgatcttacttgatcttacttcatgcaaaagcagccaacaactcgcctgggaacagactcccctcatctaccctgtgcctgctaggcagactgccaccaaggaatctgaatgcagaccttcataattccattgtaatcatggtcttggttgaactcaaaaaacatttttgggcactgtgatgggtgttagaatatcctagcagtctttctagggcagcgtaagtcacattgcctagaaaaattaatattctaatagtaaagatggacacagggacagatcgttacaattctagtcaaattccataaggggaggagccagattataacagaagtgcactgaactcaatctggagcctcagtcatgactttccaggaggagatggtgactgagctgattcttaaagaatgaacaaggtttcccaggtaaaggtggtgagagtgctcctagcagaacaagcagtataagaaagatacaaatgtgtggaacagtaagaagtacaggtcaccaatcaggtgtcctgtcagtaggaagccagcagggagtctatatctacaatgtcttagtattccagcagttgcataggaacctaaatctgagatgtggttttatcaaccaaaagtaaaattgccaaaagcccagcaaaataacctatgagtgacttaaaatcaaaactactacctatcacccctgttttagcatcagctaaatatagctgcttttagaaaagcagcttatctccacaatagtccttctgaaaaactaattatgtgaaagtatgaaaaatgtacatttcaaggtgtacgtttttttctcctacccagaagtcctcctttcaactctccagcaacgcccccttgcattcataaactctgtgtccacagagatacatgcatttttccagaaaagtcattaattttggaatttaagaaatatgaaatagacaaagtgggtaatttttcacacttagaagaatgtacccgttatgttttgactctttttcttgcacagctgagaaaagattaataactcactttctctattaattggcttcccaggtgccataaaagatggtacccaatcaagtcacttaaagcaaaaaatgcccatagcactcattaacccccaaccagagaacgtggtcatcacacattaactttccagcagctagccttcctaagaaactgatatgatattaaagctccagaggagtcaactcttaaataaattgttgaattatcctcttctccgaaaggtacccaaaagtattttatattaaaaaagtagccaagcacatgtgccaacaatgcaaaagtgtatatgattacaaacaattttattttgcagaagcttggagttggaacaattctagcttattgaggagctcttcaaattagaaggtaagagagcaaatcacaaaagatacattccaacttcctctattcatagccataagaaaaggccaggggaaaaaataataaaaggtctgaagtcctatgagactacacttaaactctgaagtctaggaaactcttactttaacattagcaagaattccaaagatttgtatttagtctaatggaagagagaaaaaacgagcttcttgatgacagcaaaaccacactcagatcattggaggtcctggcaaccagatacaaatttattcctttaggagccctgtcctttctgttgaagctcactgctggaagaataacacaacttcacagtcacagttctgccatgaaagcaggaatcatggggtacaggtgtatgagggggaggggacaggcaagagggaagaaagtgatatgtattagactgttctattcctggccacagagagagaaattctgaggcatgtcacagtgcttgatgtgaaagcctagtaagtcaaaacgggaagaaatactttcagaatcctaatggtcctattgccagagtataagttatgaggaatctggtgtatctatcatctagaaaccaaacaaaactaaaaatcacaggggaattactacaggttaaaaaaaaatgtctattttaaagatttagagatagattcaaatagctagaggagggtctgagctatttttttattacaataaggcacacttttaaatgcctaatgtccttttgttttaggggggcttgtttgttgttttgtttgtttgttttgagacagggtctggctctgtcacccaggctggagttcagtggtgtgaccttgcctcactgcagcctcctccaacccttctccacacaacttccccaatacccccatccccaccccaggctcaaacaaccctcccacctcagcctccagggtagctgggactataggcacgtgccagcatgcccgtctgattttttgtatttttgtagagatagggtttagccatgttgcccatgctggtctctaactcctgggctcaagcaatacactggcctcggcttcccaaagtgctggggttacaggcatgagccaccacacccagcctcaatgtctcttttttttaaatctctttacctttatttttgcttctgcttttctttctaagtttacctcaggaaaaaaaaaaaaattcctgctttaaattctagacacctatcctgtgtaactcctacctagcaagcattgaatacatatatttaaatgaaagcagatttatcatttaatcagataatggagaacactgatgaaaactaagtgaaacttctcagaaaagtcacacgctctttgggctttatatccaggaatccaacaaggaggaaagtaccatcccagctgagcattaattattcttccttagatttctcagctcccatgatactgcactacattgcctaagtcctatatgttaaccactctcctttgctatgtgcctataatttcttgtttattctttcctcctggctcctcatcacaatgcctggaatcacatttgtataattttggaggcaaacaaagcacttccatgtcgtttccctcttctgtttttctccttgtaagttcccattttccatttatacaattcactctatttaatagttttccttactattctatttatgcccacttactttgatgatgtgcatttatttatgcccccttcattttagcaaccatgttttgttgtccacatgtcttgaactttcagtttaagatctttagctgtgtagacttgggctagacttcatgttgtctggaattctaaaatataacaaaatcttgccatgactacatgtgcaaggatcctaagagtgtttctctcaaagaaaggataagtgcttgaggtgatggataccccatttaccctatagtgcttattatacattgtatgcctgtatcaaaatatctcatatacccaataaatatacacaccaactgtgtaccaacaaaaattaaaaattaaaaaaaaattaaagtttatttccccattcaagaggttagttcacccaatggtgcctataatattgtgtaaaaaaaaaaacaataataataatatattcaggaggctgaggcaggaggttcacttgagcccaggagtttgaatccagcctgggcaatatagtgagaccccatctctaaaaaaaaggaaaaataatagaggagaggagaggagaggaaaggaaaggaaaggagaggagagaaaaggaaaggaagggaaagaaggaaaggaaaggaaaggaaaggaaaggaaaggaaaggaaaggaaaggaaaggaaagaaaagaaaagaaaaggaaaggaaaggaaaagaaaagagaggagaggagaggagaggagaggaaaggaaaggaaaggaaaggaaaggaaaggaaagaaaagaaaagaaaagaaaaggaaaggaaaggaaaagaaaagaaaggaaaggaaaggagaggagaggaaaggaaagggaagggaaggaaaggaagaaagggagggagggggaaggaaggaaggaaggaaggaagaagagagggagggaaagaaagtaatataagccttagtgttcattttttcaaattgttcaatttatagaaaatcctaatcatgtgtttaaccgacataaagttcaaagacaaggtcttaatgactgcttactattgtggtaagacaaatatgtcacatgttctaaaaatcaatcaaaatatttactaggcccctactttgtccctacctggtagttatcaatatgtagacaccacccagataccatgccaaatgtcaaagatttttaaatcagagaaaaacctagagaaggagtcattagcatccaacagtctcctggtttccaaaaggaggtccaccacagtggttccaacctgtgagagaatcaaaagtaatcttggaagctttgtcagaaatacagaatcctgatttctacattagatctctaaggtaaataaggctgtctggaagtagattcaggaatttgtacttttgaaacttctctggtgatcagaatgatcaccctatctacaaactgctgatttatctggccttcatcctaatccacaggctagccaaaaacacaagagcgaatatatgaggttcccagccactgaaaaaagagaaaagagagaccactatccctaaatattgtgaaacttgaaattcagcaacacgattttgagaacattaagaagtcactactttcttgctgtcctacaggttaggcgaaggaagaaatatgtttaaacaccagatacggcagggcgtggtggctcatgcctgtaatcccagcactatgggaggctgaggtgggtggatcatgaggtcaggagatcgagacaatcctggccaacacagtgaaaccctgtctctactaaaaatacaaaaattagccgggtgtggtggcacacacctgtagtcccagctactcaggaggctgaggtaggagaatcacttgaatctggggggcagaggttgtagtgagccgagattgctccactgcactccagcctggtgacagagccagactccctcttagaaaaaacacaaaaacaaaaacaaaataccagacactattagttttgggtacaagagagggaagccaattacacatatagcaaaagagaaggaagaataaatactatatatatgtagtattcattatatctatagatagatagatagatagataattgaatctatagacaggttctcagagagaaagaatacgctcgcatctttcctcccttttcctatgagcacgactcaacaggacagattgggtcagtagcttaggtagaaatggtccaggtttgagaatgctaatgagcatgtcaaacaatttagtcagtcaccacgtgccacctctcattcacaagatgaatttcttttgtagtggcacattgaagggagaggtttaaatagaccttgtggaaggatctgcatcaataataatttccaagcaatcccactaggaagacaactgtctaaagtcagccgagagagcaaacaacaacaaacttcattactatctttggtattttgtaaacgtcagttcctgaagtccagccttccagcctaatgctccatactagaaaaagccacttacccaacacccctatcattctttccttttttcaatatacggtttattaatatagatgtcagtctgtacttacaacccaacataaaatatccttgaaaatggaatgtcaacagaatggtaatataccaccttgggttgatgggacagttttattgcaacagcttaatttttatcaatattatataaattatattgttacaatcatatatatttatgattagatataaagtaactgctttttccctaatgctaaaaactctattatgtgaaaccttggtgttaaaagcagggtttgaggttggcagcccatgttttgtgtaataactgctaatcctccaccaaagaagagaaatcatttggaagatacaaaaactctgagttttttatgctctctgaaacctatgtcatcaatgtggattaatatttgcccccagaatgattctgcaggtgagaagagataactgatatatattagcttagtgtctagtacttaaccacccattatgatggtatctaatcaatctatattgatatctgtctgcctacctcataaaatctgtaggtagatactattatcccatattacagaatagaatactgaggttcgataaagttacatgtattaccctagatctcattgctagtaggggccaagctgagttccaatttcagtttttgtgattcttaaagcctgaacaactcctactgtattctcctcaggccaacagtctgaattactaacacagcacgtaaacaatcagaacagagtccatgtatttattggtaacaaatgcacatacaaatcacttgaaattccttttaatgataacatagcatataattctataggggaaaaaagacaatttgtgctcttatttgttgccaatggttgcacttcattctgaaagtcatttaatattgaaataagtatctttcatgattatcctaatataaccattttagttctaaccctgacaagcagcaaactttgtcccctggcccaactttatcaagacggttgaagtgtttttttaagttattcccattttgcttctggaaaaactgggcacaggatgtttcatgaccttcctcttatgcaccctgggactgaatttgatcacagtgacaagccaaactgagaatttctaaggccaggaatacgggctgccctttcttttaatggacacatggatgaaatggtaatgtttccttagcacattaaaaatagtgactaaaaagtcgaagttttttttttttccgaatctaatagctgtcttaaatcgggtagaaaagaaagacgcaatcattccttaaatgcatatttaaaattcaccaagccaaagccagtcttgccagattttgtaatcctttccatagtctttgtaaagtacctagcttgccaattaaaaaaaaagggggaggaggagggaaacctcaagtggtttttaaccaccaataacaaaaacgacaaaggtattttgaaacatcagttgctgctagttaggagctagcatggatgtctctggctcaaagataattcttgctcatgttgggtttttttttattgcaacagtataaaatcagataaagataaataaaatgaaatggaagcacagagatatttgctctaaatatggctaaagtgaatttgtggcttgatgccacttttcgcagctttgttctccctaatctaattatgccttgaagttgtctgcatttgagaaattaatactttgatgaaatatctagccagttccataagcagcagagggagaggaaagggaaacatatatatagtattaactctgccagccttcaaccaccacaagacctcctgggcacaacagtggcccactaataaaatgaaatgatagcatatgtgctttgtttaattttgatgtcttcataatgtattacacaattagattgatttgacaatttccattatgcttgataaaatatttattgagccctgaagatgataactcttatctaaccaccatttgttctacagatgtgacatatttaatatataagtaacatcactcagatctatgttccagttagcccattacattttatttgcagagtacagtgtaaagtcatcaataacgctttgatagatccctgtctgcccggtgcttgacaggtgcggagagagcttgctcacattcagcggcaggggcacatcaatcatggccaagaaatttactgtgtgaaattggcctcatctgtctcaatgcttgatgcagatcgagtttgttcttctgatagaggtgtcgttagtcacctaagcatgcctcccttggtactcatgctctctgcaagtaatcttttttttctcccccttctcccccttccctttacatatttttgtgaaattaaaatctcgccctcctgtgaccctaatccacatattcttggccaaaacaggagccaggtgacctttgagattacccttgtgaagccttgcaggttgagtggaagaagatgctattttttgttgatgctgttctttttttttttctttttctcccctaacctcacaggcaacatgttccactgatgagaaaaccggcaaagacaggttaggcagaagaaaagagagatgagacaacggactgtgccaacaaactaaaattttacctgctgctatggataaaatagctttctttttagaaatactcatgttaataaactcctacatgcgacataatatgtgcctagaggtctggataagtaagatgtgtgtgtgtgtgtgtgtgtgtgtatatatatatatatatatatatatatatatatatatatatatacacacacacacaatttcatttgcaataggaagtcttcacactgcaaaggtctaggtagattcctagttaaatggcatttcaaattaaggcatctacccctgtcaaaggagaactccaaatggtaactggctcccacaacttcgaagtgctgctgagaccctcatcagcttttatctttgcgccccgtcattctcccatgggcaaagaattgcacaaaaatcttggagtaaacacaaacaagtgccaaaatgaagaccatcaatgatccaaatccttgcaaggtataaaagagaatttttttctgagtcccgaagtcaagattgttataggctgcaggatttttatgtgagaatggaattgtaagattaatctttggccaagagcacttctctgtttcttgcaaaggattagctgacttaaactagaggctctgcgtcctgctcctggagctgcagtcagctgtttttcctttgtggagcttcctgatatgcccaaacacctttcttcttaacctttgtagttatttcagtatttacttcattctaaatccttatgcagactttttttttgctttccaaggcaaaccttgtagatagccaatctgtactgtttccaccaaattaatgtgagagcttgttttagcaactgcaaaacaaaagtgatacacggcttcaataagacatattatcttcagaacctgtaaaagttgagactatctctagacaaagcgcaagcacaggatagtcctaccactgcagtcaaaataccacagaagctacatgccacagcaggatgcctgtcggatagacaattaaagtggcccaggaatgacatatcccctcttgccaacataattaaggtgtattatttgtcagggaggtcaacggtgaacaaatgtcctagcaaactgagaatgaaagacagggaaggagcagataatgaaattcagggatgacaaatggctcggagcctgacaccgtggcatctgacaaagagagacatccaatggctctgaaacttttcctggtgctctggaaggctcttggatttggggcatttttacataaaggatgttgcatgtatcattaatgtcattccatttccttatagaaaagtattaatattgacaactgtagaagaatgatattgtcaaggcagaattcaatatgcggtatggtttttgtcatgtgtactcactctgctgctcctttgtgtcctatctacacttgttttacagccacctagagtaaccagcctatctccacttttcccattacttgttaatagctattgtgcagataaaaatgcctcagagtgacctatagggacacctctgcctttggccaagcacccccacaagtgagggtacgaatacttcccaagctaagccaagattgagttatgttcagacaataagtatcaccaattactacccttcagttgttcccagataccaaaggcttaaccacccacgggaatagcgactggtgcctgccacttccctaaggttgtgtgtattgtgctaggatatttgatagacttgagtattatggcttaaaaaaactatacaggagaagggatgccaattcctaggctaaaccagcttcctttgtgaacaaatatctgggggtgttcctctgtgataaaaaccatttacgtcattttaggcccatttttaaccatactgggtcattttacaattcagagagcacagattaaccatacagagccagcagttattgatgtggaacacagtaggactccacaatcttgtaatgctacaatgatgtagtcactaatttgtttctgcatctagcattatttattcaccaaaatatttgttgatcacctattatgtaccaggcatagaactgaatgggagggccacagtagtgattcagacaaacataatccctgtctttactaatactgtagccagaaagacagacattagccaacatctaccaagataactaattagtcataaatgtgataagtagcaggaggaatgctggaaaagcttttgaccagcaaatctaacatacgctagggtctcaggcaggaagtgacacttaaggtgagatataaagcaagtaggaattcacatagatagggatgtgagtgtgtgtgtgtgtgtgtgtgtgcaagagacagagatgagcagcaacaagaaggaaagggaggcgtctaggaacagtatctcaagcagaggtaacaaagaccctaagaaaggagaaagtttgggttggtggaggaaagaatgaagcccagtgtggctggagcatagacagtggaggagacggtcacaagggtgaggctggaaagacaggcagggccagaccatgcaaggctttgaaggctcttctaaagattacggccttcacatgcctctgcaattagagaaagcactggaagtaaagccaagcagatatcagccaatgtgtctgagcagtaaagatatggaggtgaatgaaacgtctcattttcagattttctcttacctaaaaaaaaaaaaaaaaaaaaaaaaatttgcctgattctcaggcacaaatttagaaagcagacacatttggtgatataaccactaaaactcatgcctaatgtcttctaaattttatggccttttccttatagggacctgaaaagctcttgacaaggcaggaacgtgactaatataattgagcacatactctgtcccaggcactgtgccaggcacctttaaaatctcttattttaatactcacaaaaatgttaagacaaattccccattttttaactgaaacaaatacagagtaagtaaattgtccaatatcagaaaactaccaagaggcctgaatgctaatccatctgactccagattcgatgtactttccacagtgaagacaatggacttttttctacattgattcgccttttggtcaaagtggagtcatcactattggtataaaaaaagtatgatgatggttttctgtaggttgccaaagactaacatattgacatgtgaagaattcaaatataattgtgttttttcaagcaagctagtgctgtcttctttttatttaattgaaagagcttctttatcacatatactgtcccatgaataccttccatcctaatctccacctcaaagcattgggctctacctgctagcttgccttcaacactgcaatctgagttcttcaagtactactggagtacttcccagaagtaggaacaaaaggatttacaaggtgtatacaggtggctcgctggccctacactgctcttcctccttctcatctgctctcagtccactgctcccccaaccccttcccctgtggctgccattcctctccttctctttcccactttttttctcatctctttagtcactttgcccgtaccatttataatacctctttacgtaaataagttggccttttatatcaccagccatttttccttccactagtcaaagtataggatcctttagtgttctctgctgtgtttgtccaagctggttggttgatgatagggcgacctggtaaccaatgaggtgggtggtttttgttcttcaaaaaggagatgaagggagataagctgtttctgagccacatcctagaagcctgtgcttttcaggaggctcctctctgaagattaaggggcatatttgtggatgtgtgttttttgctgctactgtctgcagagtgtcaaggatcaacacattaaaagatgccatttttcctggtgtttctgagttcttggggcgggggggcttgtttgttatttgttgttgttttgttgagttttgtttttgctatcctcattaacaatacatggcacaaaatcttaaaacacgtttctgtacttcacaagtcaacaaaaagagagtgtacatttctgttttaaccagaaaaagaattaaactttataaaaataaataacacctgcccccccaaaaaagcaaatcatcaccccaggatgacagaaaacatcggttaaaaaaacaagttaagaagtttttaagctgaacacaaatctactaatgtgttaatcggtcatggacattagccaattcatgacttttagctgtatatcttggcatgttaggttatgctgggtattaaaaacaattctgagacaatgttgggattggcaattttaaaaaagcctcagcactttgggaggacgaggcgggtggatcaattgaggtcaggaattcaagaccagcctggccaacatggtgaaattcagtctctactaaaaatacaaaaattagctggacattttggtacatgtctatagtcccatctacttgggagcccgaggcaggagaatcgcttgaacctgggaggcagggggtgcagtaagccaagatggtgccactgcactccagcctgggtgacagagcaagactctatctcaaataaataaataaatacttaaaaataaaaaaaaaactaaaaacttttcacagtgtctagaatataatttgtctattccacaaataaatatatattattccagtgacaaatctgtgtgtgtgtgtgtgtgtgtgtcctcaacacacttcactagcttgttggacatttccctagacacaacaacctctggtttctgttaagtaaaaagagaatgaacattactgcaatgactgctccatggtgaggtgttagcttttcatctacatgtatatggagcaaaaaggtttcattcttaattacaagtcatcattttaataccatatctcaaagatctgccccaactggaattcccactgggcactgatagttttcatttgtttcttctttttgttattgtttggtggtgggaagagaaatgtaaagtacaactcttgagatcatgttctgaatcaggaatttatagactggagggaatatgctatctctctccttaaaaattcaactctaacacttcatgcatagatatcaagtacttcattacatttccagtcactgtgaaataacagtttcttttacctccaccacgatcttattagagaaaaaaaaagcaactaaaaaaaaggggtctaaatctcacagtctgtacttcccttacaggctgcttacaaagttctcatgatgaaactaagacacactggggcgtgtactcgcctgtgtcattcaccatggggaggagcactgcagagctctgttacaggggagcttaacccacgttctttttttttttttttttttttgagacggagtctcgctctgtggcccaggctggaatgcagcggtgcaatccgggctcactgtaagctccaccttccgggttcaagccattctcctgcctcagcctcccgagtagctgggacctgtacaggcgcccgccaccacgcccggctaattttttgtatatttagtagagacggggtgtcaccgtgttagccagaatggtctcgatctcctgacctcgtgatccgcccgcctcggcctcccaaagtgctgggattacgggcgtgagccaccgcgcccggcaacccaccttctaacaagatgaagtcatgcatcgagaagtcagtgctcattgtctccttggcagttcatcttactaaaaaccatcagctggactgaagaaaggaactcatattaacctactctgagcagactcttgattttttatttctggtgaataacactgtgatatgttacatgttttagctctcaatgaccgaaacatttaaaattgataggccttttaaatctatggccacgaagcagggacttgccaatatttctaatggaagtctccaaaagtacataacaatacatatattgacttcttgtttcaaggagtatcaagattaattgttcctgtaaaggtaaataaatattgacagaggtttcactttggtccatattttccacttgggtcaataaatcttggtattcacctcaactcgaatcagtatcaggtgattattaattcatggtatactcgactagcagccaaaactacaacttaacatatagaacacagtcctgcagaccaatttatgtttaaataaatacatggagtgaaaaaccattgttttatttttatttttattttttttttttttttgcccagaaacccgcattttattgacagtcattttcccacagagaatcttagaaagatgtcgcattttcttttaatgaatgagagaagcccacttgtatccctgaatcattgagaaaagcaacagatacaactgacagtcacactttttaaaatcaaacagtcactaccttcagcccacacctccacacccgcatctgcctccccaatggctgtcagttcggtaaagtcaccctctccttctactctggtattaccacgagaattgaaatttttaagcagaaaaaaaaagaagtcaagttacaaataaatgagtggcgaaccaagggaagccctttgactatgatttccaattttctgttcaatccacactgcagagatacaaggataaaccaccattttggttcccaagttttattcaagaactcatacaaaattttccagataaatgaaatttaatcctcgtcttcctcctcttcttcgtcctggttaatctggaagtaacgtaattcgtaactctctttgctgttagcaactacgcgcaaccagtcacgtagattattcttcttcaaatattttttggtgagatatttcaaataccttttggagaaaggcacctcggatgtcacggtgatcttgctcttgctcctttcgatggtcaccacccctccaccaaggttcccagcttttccgttcactttgatcctttcttgcaaaaactgctcaaaattggcagcatccatgattctacagggtgggtgcaatcaagagtgaacttcagaacttgcttcttttttttgcccccaaaaccattgttttatataactaatggaaagtacaacctatagctaccaggcatttaaaataatctattgttattctgttatatttcaatttctctagtaaacaaaaagtgattctttttatctcacaattcaacattttgctttgcccaatcccattactgcttgcacttattgatgagctttgtaaatatgtgaatgtttataacagaaagaaaggatgaagaacaaaggaaggagaaattttaaaaagaaacaaaagagaaaaaagaaagaaagaggagataaagaagagggctaaagaaaatattggttagaagaattgagagacataaaaaatatggaaggtaaaaggtaacaaacttagggagaaaaaaatttaaatatcacagctgattagtgtgtacttccataaatttcagcaaaagatatttatttctttccaatattcttttccatttaaaaagatgctctgcccaattctaatgacttaaacatcataaatattctagttttccattcaagatttaaaatgcaattagctattaacttatataaacacctcaaagaaattttaaagaaaatttattttacacagtaaatttaggagcagttgattaaagttttcagggattgagacatctcagctaataatggaaataataattaaatattaacaacagatggatgtttcacatgaaattatggcacttttatttcctatgaaggcacactaacattggaaggcagactccttaagagaaattgctcatcaacactacaaattgacaagcatatcaaaagagttattgatctctatagcataccagctcagatatatcagtagtaaagcaagcaccgagactgattacattagctagttgatattacttagggagagctttgcctattaacggggcttcaagtgcacctttcccgaagtactgcatttctgatctttactcttgcttatttatttatttatttatttattgagatggagtttcactctttcacccaagctggagtgaagtggtatgatatcggctcactgcaacctccaccccctgggttcaagaaattctcctgcctcagtctcctgagtagctgggattacaggcatgcaccaccacgtctggctaagttttgtatttagagtagagacggggtttcgctatgttggccaggatagtctcaaactcctgacctcaggtgatctaaccgcctcggcctcccaaagtgctaggattacagggatgaaccactgcacccagccgctcttgctcttttaaatcaaaataaggttaaaaacaaaattttattttagccagaatattctcgttagtgttatattaaccaatcactttgtagtcaacaaaatagtttaaatgcaaatttaccttagagataatttattttctaagaattgtgagacattcattaacttaaatttaccaactaaaaagagagggttacaataaaatatctctagaaagctaagacactttatcaaattactagaagtttggaggtgagaggaaacttgaagatcatctcatccaacattttcactttaaaaagagggaaatcaaagcaagagagaagacactcagctacttagtagcaaaggcaaatgagtatgcagatctttttattttactaaaaaggctgcgtgctcagatacactccctttacttttcaccttcaaaaaggcaatttggcaacgaaatatgcgattttgcatttagctaataaatccaccaatagagataactttgaaatgtacaattcttcctctaaatatatatatgtatatatatgtgtgtgtgtgtatataccatatgtatagtatatatgtatatatatgtatatatagtatatatagtatatatgtatgtatatatagtatatatagtatatatgtatgtatatatgtacatatatactatatatacatatatatatagtatatatatgtatatatatactatatatatatgtatatatagtatatatatatatgtatatatatatacactatcccagagacatcaccaagtttgatgtggttttaggtgtggaaatatgaagagcccactaatataaaatgataaactctctttttgtgtttttaattattctttaaaagcaaatcaacaaacaataacaaaacaaaattatattcaacccaagcatgaaagcacttctccacaatgcctaagttgagtctttaataatagtagaagtttactaagtaaaggaggatagctaataatgaagcagcacatgtaatggcattgaaacaagagtgctcattatacattccaggaatgttaaaaaattttcaacttaagcatcaagtgtttatgagagaagaattttgaggccagaaaccaaacagcaaggctcagatctttccaagtatttggagcttgttctgtatcttcatggtaaaccatgaagaattaatatgatcagaatctcctttgagaaagataattttggtatcggtactgagggaatgaagaagaaaatgatacttgatgcacaaagatctattgaaaatatattttgattacccagaaggggaagaacacctggataattaatcaatctgagttaaaaaaagaaaaaaggctatctcctgggatttaggattggaatagagaatgaggaatatgctcatcaaatataaactcagtctgaaacccccagaaacaaatgtgaaactactccaaagcaacgtattctaaatgtaggctctacaagattttctcagataaagccttgtgaaaatgagcacacagccccaaattacaaaacattcaagcaaatactcttttaggagagaaagcaagcagacaaaaggaacttcaggtttagacataacctggttgacctgtagaataatcttctagagaccacaaaatgtttccttaataattaattaatttttaaatcatcaagttctatttagattttttttaatttgtcattagagaaatgatatctcatgtctttcttttggttttaatttttatttcacatttttaattgtatagtccaaaaactaattgaaaaaaaagagtaaaataaagatattttcagacagacaaaggtgaagagaagttactactcacaaaacattactaaaattaatctaaagaatatacttcaagaagaataatattgaacccggaaggaaggagtaggatacaagaaacaatggtgagaaaataaattggtaaataatgtgtataaatctaaataatcattaattgcattaataacatgactcctttggaagttgtaagtacaaggtgaaacgaaaacacttggcagcaattagcatgtaaactgggggcaggggagggggacaatctgaattaatgtgatctacagtgtttccatatttcagaaagagggtagatattacttaatgtgaggcttgttaattatgcacattaaatatctatttgtgcttatttaagaaaacacaaatagaatgtaggagagggaaaaataaaaaataaataaaatttggtgaatcttacaggaagcaggaaaggagaaagaaaaacaagtagaagaaaaagaaacagaaagcagggcaaatacaaaacagaaaataagaagaaagaaataaatccaaacagatctctaatcacaatagatatacatagcctagaagagaaagaaggacaaatttatttaagaaacaaaatccagctatgtgttatttggaagagatatatgcaaaaaagggagggggcgggagggtcggggtggggggactcagtttggaagtaagtggatgaaaaaaatacataccaaaaaatagaaagctagagtggttacattaatatgaaacaaagtatacttcaatgaaaaaatcattattccctaattattacaaaatgacaaaaggaaaactttaccagggagatacagtgtttggaatttataggcataaataaattggaatttatttattccaataggcttactggaatttatagtttaacttccaaaagcatgaagcaaaaattgacagcattacaagaaataaatggacaaattcacaattataatggcaaatttcaacacgcctctctctgtaattaataaagacccaaagttagtagaaacacataaaatttgaacagcataattaacaagtttgatcaaacatatatagaagtctgtatacaaaaactatttttccaggccaggcacggtagttcacacctataatcgtagcactttgggaggccaagatgggtggatcacttgagaccaggagttcaagaccatcctggccaacatggtaaaaccctgtctctactaaaaatacaaaaaaaaaaaaaaaaaaaaaaaattagccaggtgtggtggcacacacctgtaatcccagttactcaggaggctgaggcaggagaatcacttgaacctgagaagcaaaggttgctgtgaaccgagattgcaccactgcactgcagcctgggcgacagagctagactctatctcagaaaataaaaaagtaataaaagtaataaaaacactatttttccagtttatgtgaagcatttataaaaatttgccatatttaaccacaaagaaagcacagtacaataaaaatgaataacaaaactataacacaactcatgtttagaaattttaaagaatattaaataatatatgggccaaaagagaaatcatgacagaaattataaaataatttaaactaaataatattgacaacattatatatcaaaacttgtgaaaagcagctaaaccaatattagagaaaatgtatagacttaaatgtttatactaggaatgaaatggagtaaaaaccaatgaatgagtccaattcaaaaatttagaaaaggatgaacagaattaaaaaaaacaaaagtttttaaaagaaaagtaaaataccttttaaactaataaaacagatgaaattttggcatctgaattaattttttaaaaggaagcataaatgaaaacattagtaatttaaagggggaatacagatacacaagagatttttaaatgctagatagactactatgaacaacttttaagtcaataaatttgaaaacccagacaaaagaataacttcctagaaaaataaaacttactgaaattgacgcataaataaagagcaaatctgaatgtaaccatttaaaaagttgaatatgtagctgatctccaaaatacattaacctagtattaaagaaggggttttaacagattttcaagtaaccagtaatcccatcctaaagaaattgttctagagaacatatagagaaagtgacaagtcaaatcaatctaaataaaaatagaacaggttttgtatgtgtgtgaaacttgacaagctgactgtaaattttatatggaagaataaatgactgaaacaatcttgaggaagagaaagagatttggcttacagatatcaagatatccttaaaaagatgtgacaattttaaaaaagtgtttgtggcatcaggataaagaaatggaccaaatgatcaggacagggacccaaggaacaaacctgcacatttgtgggaacttggtatatgatggagaaggcattattaataaatcagtggggaaaagaataattcttcaataaatagagccagaacacttggttaggcgtagaaaaaaggataaaactagatccttacctcgtatgcaaacaaaaattaaatttcaaataaatacctaaatatgtaaagcaaaatagaaatttttaaaagagaaaatagctttataatatcagtcaaaaacaatttctaaaacaagatgccactatgcataaaagcacaaacatataaagtataaaacgggatattcatagatttgactacttcaaaaatagaaattcctgttaagcaaagttcgccattaacaaagtgaaagacaagccacagactgagagatgaccttgcaatgtatgtaagcaacaaagcattagtgtcatgtaaaactgaaaaaagaaagcctgtaaagaatatgatacaaaatccacagaaatgaaacctgaatggccaataaacatgaaaatatgatcaactttattagtaaagagagaaagtcaaatgagactttgcatgcgctttagagtttcaaaaattaataaatctgataatactaatcattgtatgagaggacaggatgaagagagatctagcaaaaatagaaattgaatcactcttattaggagtgtaaagtgtacaatcaacacgagctgttattaggtggcaaagttaaaaatgcacatagccacaacccagcaatttcaattcaaggtatcgatcttgaaaaattctcacacaggtgcacaaacaaacccaaacgagatgctagatacagccctgtttgtgataacagaaaagcagaaacaactcaactatttttctaagtagaggaacaaattaataaactgtggtgtattcatagaatagaatatcatatgacagttaaagtgaataaatctgttgaatctttatcatcatggattaatctcaaatacaagatgttgagtaaaaaaaagcaagttgaagaatgatatgtacagtatagtaccacttatgtacattttaaaacatgccaaaagagaatctgtagcttgtgatggaacatatacagttaaagttcaaaaatgaacatcgaaatactttacaccaactttaggatataggagaagagtaacagaaaggaggggtgggcctttatctgtaatattttctttcttttgcaaaagagagtttgttagtagatatgcaaaatgttaatatttgagtatataggtatttttatgttctttttcatgtatttgaagcatttcataatataaaaaaaatgtttttttgtagtgacagggtctccttatgttgcccaggatggtctgtaattcttgggctcaagcaatcctctctccttaacctccagagtaaccaagactataggcacataccactatccccagttaacattttaattttttgtggagacgggtctccttacgttgcccaaaccagtcttaaacccctgggctcaagcaatcctccactttagcttcccaaagtgctgggatttcaggtatgagtcaatatgcccagtctgaaacatttcataattaaaaatcaaatgaattattgagtatataacatgaaaaaggagaatagatattgccacttagaaatcctggaatcaggtctaaagtcactccagagacgattgctgaccaaagtagatccacccagggcaaatgtcctaaccaaaaggcctggagtttcctccaggtctcatgagtatggactacagatgatactagaaaaggctctaggttggtgatttgcagaccaagacttttaagtatcagtaattaaaataaataaattttatatacatacagacactaacattatttcacaaaagaaaaggcactataaaacagaaaaataagaataataatctcacaataatcaaacatctttgaaatgaagacttcaatttatcttcatgaataactacatttttctcattttgtctcagaacaatgaaaacttcctaatagactaagaggaaaccatatcccaatgtttgggacctcttgtttcagaaacacagtcagcattgttaccaaccagagccacgtaccaacaaaactagctctgtaagacatttgtaccaacctcaagtggattttagaaactacatgataaattttcactttcttcatcaatccttctagtttcgtgtttcaatcagaaacatgggatctccaagactaaatgtacaaaatgctatgaatcacatcacattcatctattgccaattataaaagttgtttcttttcctggttcaagaagtgatataatttcatctatttttgctatattttgccttgtttgtttaactcaataaaacaggcacagaccatatttaaatatcaaagaaaacacttttatctgggactagaattcttaaagataagtgctttttaagcttcccaagtttggtacattagtattgtcttcaattctgctcagcacaaacacacattcagtttcatggggtcagtggcatgaccctactgactttgaagaagagttttaaaggaagagaagatgcacagtgttgaaaatagatatgaggctatttagatattatagcaagtaggagagaaagttcgtggggtaagaaagaattagctttcaatgaaaagcaaaatacgacctagttgaccaactcaatgaaacagcagtcaagtccattgtatgagagcaaaacttgttgaataaatggatcacttttccattcattcctttgctcaattccaaagccattattataggtttggccaacctcaggacttgtcatccactgaagattattctggaatttttatcctgaatcatatataacaatccctgccttcaatgtataatattttcaacctaagtaggaaataaaaaataactacttgtgttaagcgcagtcacaaaataatattaaagatcaagttaaatacagttatttaccatacacgtgtttaatactattattatataaccctacctataatactgttattaaagaaatagtaataaatggagtaaccagtaaaattaactcatattaggcccggcatggtgtctcacgcctctaatcccagcactttgggaggccgaggcgggcagatcacttgaggtcaggagttcaagaccagcctggccaacatggctaaaccccctctactaaaaatacaaaaattagccaggcgtggtggtgagcacctgttgtcccagctactcaggaggctgaggcaggagaattgcttgaattcaggaggcggaggttgcaatgagccgagatcacaccacggcactccagcctcgaagacagagagagactccattttaaaaaatagtaatgataataactcatgtttagaaacataatcgtacctacctgtcttttcttatttaaatagaatagaaagctatagtcagaacaatgaacaatcttcttgttcaagcgctgaaactttagctaatatgtcttttagtcactgtattctatcatttttcttgagcctccagccataccatacaactccatttattcgttcaaaaagatacttgaacatttgctgggtaccaagcactggggctcaagaacagaactcaccgttaatatggtttatttgcaaatatggtttatttgatcaagtagcatgtctcataaaacttgattctaaatacctgtgcaacactgtcattttatattcctcatcttcaaaaggaataatgaagctttaatctcttgcaaaacctgtatggttcttctcccttctcagatagcaccacgagctcccaccagtaacaaaaccacattgctgcctccttcactttgcagttcccttagaatctaacgaggaacaccacactctgctttgaacactgtcttacatacatatatatgtatgtatgtaagacatacagacatatgtatttttatatatacacatatgtatacatatatatatatatttcacacatacactgggtgtatatttatatactgggtaactgaagttcctcagatgggaaatgatttaatctgtagcaacgtctgactctgcatataatgctgtgtgaaacagaaacagccctgacactttatgaatagggaaatgagagagcctattgaagaaagcttgacagcaagaatgaaagaatgaagattcaacttaagctgttgaaagcctaacaagataaagggcaggagagtctccttaaatgtgatgaaataaggcctgaagggaaggaaccatagagagattgacgagtacacactttgaaacagaagatgagtgtgttcaacctgacagtaacgtggttaaattaatcaaagtaccaataaccttaaacggtaggaaagaatacagatttatgcagcaatcatctttgatggttggtgtgaaatttgagctagatcaaagaggtagagcttttgagggaaaataattgttatgattatacagccttctcataacatgtaaacattacactgaccatttcaccgtcttctctgcttgccttgtgttttatttcctccaccttaatattttaaaacaggggacaatctcagtttttattacccaaaggaaacacctaattttaagtgatgttgctcttgtgatttttactgataaatttttgagagggaatattttcagagagtaaacttattggtaaaactaacaagttgacagttcacactgcccagttcttcctctctggctcccaagggcgtaaggcagcccaaataccaagcccgctctttgccttactcttgattcatgttgctatgctttgcaaaactgctacccaagaagtcagatgccacaagttctaactgttgagaatacaattaaagcaaggaaaagttaaaaagatcaaactattctcaaggtgtaagcattgaaatacattagctataagctaactaaaatggccaactaatcaaaacaccccattgaatacactcatcaccaaagttttattatacaccactaagatcttcctgctttcacctatctgtattaactaatcgagagcacaatcttttaaagcacttattcttcaagggaaggtagaggacagtgagggaccctggagcatctgtattttgtaaaagctcccagtgtggtgattctgattcatctttctactccaaacttccaactgagagtcactgccttcatgagaagaaatcttttagttatctattaaactgtttcagccatggtgccattcaccttcatccttatcattaaaaatcaataatgatgatccaaggaatggaagagagtcaataaatgacactagtgaggatggagaggagaatcgtgtttgaaattcacatctagcttaaatcttccctgttgtaggctagatccttttctccttcttggaagacatttggtcaccatgcttctcttaatagtccttcatacagttgaggacagttattaagtcacctctaaaccttctcaataccggtaatcctgattccattcatcttttttcatcagtgctattttccaacccgttaatcattttcattgctctcccctggaccctatccaagttctccacgtatctttaaccttctgtgaattatgtgaccggtttatagctttgataagcctgggtagtgaaaaaggtagaatctcatcacaacagactataattgtatgtgggggaggacagggatggagcagcagatggttcaattgtacagaaagtttcaccacaaatatgatattaatttaagtttttattctttgataattatttctaaacacaccatattataatattctgagctacaattagagtctgtattttacacacctgtctttttagtgtgaacctgtgtctggcctggttcttttgcataatagaagagactatatttttcgaaagaatgcttgtttcttagttgaaacaacttttaattacaaagaagtactattcataacacctctaagaaatggagagactagcatattttcatattccaatactcattctttccatggcttttccaaatgaggctaaatggcccaaacctgaatatactggtaatttggacactggcctcactatcaaaactatgaaccagtcactcacaaaagctcttcagtttcaaagccattagtcacattgtacttacagaaggcagcatggcacagtgatgttaattgatggctggccgcttactagctgaaaactttcagcaggttggggttgtcctttcctcttcttttagaatagataataatagagctgtgtcataagactgatgtgaggatctcatgagctatacctgtaaagtcttcaaaacagtgcctgacacatagtaagcataacgaccctaccagtaaaagggtcgactccaactagaagtcacaaatatggagaacaaatgaggacatgcaaagcttttctcttggatctgcatttaggatatgggagcctcctcaaacaagaaaaagccctgttgttatggggaaattggaagcaaagaaaattctgcagtggccagtggcagaatttctcaccattgaaaacatattagggatgggcagagtctatcaggagttcactggaattcagtggctagccagttgcctctataagccttaaagattcccttgaagacagacaatacacccgtctttggaaacatattctcatgttagaaccaaacgtgcatatggaaattattatcccttagctaagagcttttgttttaaaacccttgtggtgtttgtaacctaaaagagggatttcctcaagttttctaaaactgcctcattttttttaagaatcaccatgatccatacctcatttgagatcaagtgaatcgtcaaactaatgtgttttttcaggaagctaattctgtgacttccttaaagagagggttgctcttcccaagggttatcggcaagccactgctctggctccttgtgccagttgttcttcctgactggccatttcccctctggctggagataaccctgcaatgacttcaaattctttcgttcagtatctgattccatctccatcataaagccttcctcagagcatggttggacctaagcatttccacgtcttagttcattcccaagatcccaagttgacttttgcttgaacttcagtggaaaatccaaatcatgtgaaaatcaaaaagaaaataatggctctttcttgattctattttctaaacatatggtaatgaacaataaatgtttacaggtagctgtgatggctacagaaaaattttctttgggacccccataaaatagattatattcagtaaacacagccaagcatgcataaactttaagaaagattttagccttctatccattcaaactattaccctatttcttccctctttattgctaccattccttctgaaaaagagtttataaattcataacacattaaaatgagcagactctttagttccttaatcctagcagtctgatttagtaatttctttaatggcaatattattctccccatgccacagttcatatttgacttctcttgactccttgcttcccacttactatcagcaaccaagtcctgcttattcttaccttattatattgttctttctatccctattgccacaacctacttcaggtccttatcatttactcccaatgcttcttttgcaatagcccactaactagctctctaattcttcaatttttctctttttctttttcttttttttttcttttgagatggagtcttactctgttgcccaggctggagtgcagtagtgtgatctcagctcactgcaacctctgcctcctgggttcaagtgattctcccgcctcagcctcccaagtagctggaattacaggtgcctgccaccaggcccggctaattttttttcttttactggtatttttagtagagatggagttttaccatgttggccaggctggtctcaaactcctgacctcaggtgatccacccgcctcggcatcccaaaatgctgggattacaggcatgagacacagctcccggccagtttttctctcttgtaattcatcctgcatacctttgccaaaacaaacatcctaaagcataattctgattatgtctcctcacatttcagacattccaatggcttctcattatgtctaaataaagttcaactcatataaagtcaatgtgtttgttgagtgaatcagtacaaaaattccatatgtaggctttagctatttatcgaataaagtacaaaagaagagttttgttttgttttgtttcttaggccaacatatgccatatatcctgtttgtggcctcagaaatgtgtgaatcacattgataaatcagctgaaaaaacaaaagttagtattttacaccttctcttctctagagtcttaaaaactccttcagacttcaactgaatatgcgctttatttctgttctctctattgattcttcttcattaatgtttaatccaaggagctttgaagtacaagatgacaaaatacataatttgtaccaatgttcacaattatttcttccatatcagttaagtgtaatttgaaatattatatcttaaattaataaagaagatttagtaaaaacatgtttacctgtgtgaaaaatatttattgaaaataaaacttatttttaaatcccacgaaaataacagaccaaaatggcagtgtaagtacatgccaaaattgccccctgttcaaaagcgagaaataatggataatgatttttaaaatatatgaaagtgaaactctgtccaaaagcaagaaagttttcatggaccataaaagaaaaggaaacctacaatactaaaggatgctcggtttatgcccaaagatgaacagtaggttttgggtttcagtgtttatacagaaaagggcctgagcctgccccacacatgacccaagtacactgcataaagccagagttaaaacttcactgccagcctctgaacagaaggctgttctatccacactatcacaagacctggtggagttgaggcaactgctgaattaccatacagggaagaatgaattcaagaaaattcccatgcaagataggctcttaaaaaataaatttacacaagaaaatcagcactgtaaaggtaattgataagcccaatagaagggaaacctatacaaagaaatagaaataactaagcaatctgaaatggactttaaataatgatgtttacaattctctaagaggaaaaggagcattagcatcagtgaaacaaaagtagggctatagaaaaaacaatacttatgaaaaaaaccaattggaaatttttagatggaaaagcgtgaagtaaaaaattcaacacatggtctaaagaataaactgcacacagctgaagggaaaattagttaattttacgaagaaacaataaatctcacagaatgtaaagagataaagatatttaaataaatcagagttaagagatataaaactatatacatatgagtatataaatatccatatgtttatatgtatacatatatataccagaaggaaaggacagaagagatacaatatttgaacagatcatggctaagttttccagaattaataaaagacatgagcactagaaacagtcacaagaagtaccaaaaaagaaaagtccaaacttagagatgttgcagtaagacttcaaaaggtccaggatacagagaaaaatcttaagcttgcagagagaaaagacagattacccacaaaaaaaaaaaaaaaaaaaaaaaaaagagtatagtcagaataagagaagaactgttctcctcaataaccagagctgctaaaaaacaatggacaagtattttcaaagttccaaggcaaaatagctaaaccagaattctgtatccagttgtcaaaccatcattcaaaagagcagacaagaagaagatatttccagacttataagacctaaaaaagctaacttctcaggagctatcttggaaagaaatactaaacaatttacttcgaccagggggaaaaaaaaagaatgggatgcaaggaaaaacagggaccaaataagtcaacaaaacatgctgatatatctaaagcattatatgctttaaaagaagctagaacataataatgtcaaaaataggagttgatggcaagatcatgcaagagattgaagggatgttaaaatgtattaaagtccttgtcttcctagggaggaggttaagactactaactgcagacatttttaggaaaattaaaaattataatgtatattaagggtaaccaatagaggaaaagcaagaataaaaatacacagcttggtaacattttctaaggctctctagccctcactatctatctccagaagagataaaaacatcctgttaaaactacagatcttgctttatagtcacttatggcaacagtgtgaaatttcccagacagcactatattcaatcagttacattttatagtttttaaataatgtttaataatttaacagtaggataaaggaagaaggtttaaaataactgaataaaaatattagaaaaagcctatttattagatcataaaagtctatcaatggatactgttagatgatatatctgaaagttaaataaaactggatgaagccccacacaataaaagtcactgatggcatttggacaggccttccatgagagcagtggattaggcaatcaaataggtacatactcctgtatcttccataagtctgatggcttttttataaccatctttttaaaagtttcaatcattaattgattattcagctatgaataaatacatagatgaaacctgtgtatgtcaaaaagagacaaaaccatattttaaaaattgatatatggagaaaaaccaaatttaacattagaattttgaatactgcaaaataataatggtacttgtttctgagtgacatgattatagttgacattttcttttctaaacaaactttttaatagtttatacaaaaaaacacatatcattttctattgctttatcaggcaaaaacaaatgttttaaaattttaacattttccacatgaacccatcttataaggatttaattactaagcaattatataaatttaaagaagcatttcaaaatcctaagtaattcttctaatacaaaagtagttttaattgattggatattttaggtttaattattcacctacatgtataatattagattatgtaacatgttgcttattttaaaaacagggctaaatctgattatataaacttaatctcttccactgatacattgacacagttgttaaaacaataaagtctcaaaggagagaggaaaagttttaataaagaaaagttttaagaaaaatcaatttattcttaatctaaatagaaattaagttcaatttgatcattgtctagatttttataaactcaatgcatttgtccgtagaattcaggaatacaacttacttatctctctgttaacgcctgcattaaggtacctatacaatcaggcccctccagatttaataaaaacacttatttagaaatattattctcagatttccaactataacagggtaactataaggtttgcttagaatttgaatatacatgcctgggttgagttaagtacattaacatacagattccattctgcatgactctgtataatgtaatgaacactaacagacatcccatttcctatatctcatatgtagaaattacatccctagagctaaagactagaaaacagacatcagaatttttttttaaagtgaaaagcattttctaataaaattactgaaaggcattttacattcaagatataatgatgttctacttctacttaatatttttatctttatcaattaaaaacaaacaagaaaaccagaaaaacctcttattggaggccacgtttttaacccagctctgaaagactcatttgaatattgctaataaaaaatgtttacatgccatttctacaaattcttattattgcatctagctcaacaagcaagtctgcaattaacaacataaaacattctttcctatgccgttgacaagatttttaatgaccaggctagtcatttaccaacttcctttgcttaaaatctaataaagaattcattcacttttggctctcattcatgttagctagagtttttctcatcctcaagtagagaatgaattcaagattttaattagaaatgttggcttccaaagctatactcaagcttttatttttttaatttataattatgtttaaggataaaacactgtgcagaagtagctacacaacatgattgctgggtcagccacttactggttcaaggtctgtatcaaataattatactggctgaaatccacaagaaataactgataacaataatgctacacagtgcattagactttatttagcatcaccacatatgtcacataatgtaatattcacaaattgtgggaaaagcaacattatttatgatcctcattgtagttattgttttctcgcaggccaggatctacttccttttcctacagtgctctgatttccttttgaatattcacctgttactcacagaacatagacaagaaactggattcaaaaacccatctctcttacaagctggcagccttgccaaattagaccactcattggagtcctttctgtgaacttgatgcttgcacagagaaataaagatacaaaaaatatttagaggttttcatttcagtggcagaatccatatcagattcttcctgctacaagacctatcctgatctccaactccttggagatgccttgactactgtcccatttccaagtctgattttcctgctttcctttaattctgtgtgctcccaaacctattctaataaattttcttttgcctaagttagccagagccagtgtctgttgactgcaaccagagacccctaaaaacacccttttacacatcaaatgcataaatgttaagtaattacccagagttgctcaatgaacaagaaagtggtaatctcatgacttctaattcagtgttctttacactctgccacagataaagatgatcatacaacactttttaaatatagagcttggttttccaatggtaaaaatggctttaaagttcaacatcattataggagtaatttgtcctcaggaagaaatgaagaataatttaattttggatagttataagtatgtcatagaacttttagaaaaatgccactcatttccatcagcaatattttcagattgttataaagatataaacatattaaaccatatgcttcatatattaggttatcaatgcctactgttgactaactttcccaaatacttctttcctgaattcagatgccatataaaagaaagcaaaaagccactgtaaattaaatgaattgagaacactaacaacaataatggcaaccattatttaagtacttaccacacaccaggcaattcattggcatgtatcatacgatagtaaattctcacaacagctttgcagagtcagtgtcaatatcccattttagagagagtgaactgggacttacagatgttaagtaatttgatcaagttcacataaccaaaaaacgattaaaactattatctaaagcccttatttttttctgtgcataccatatataatctcagaaacactaaagagagatgtcagtatagagctttatccctccaattcccagaggcttagacaaagaaaacgttggtgaaaccattggactctatgacaactagaactgcataaatcataatcaatagaaaaactaaatttatctctagaatttggaaaatcacaggacatatatgttaaataaagattctgaatattacagtgattgaaaagacatttacccccacttaatgcaataatttgaaccagaaaagccttgcattttgaaaaagtttagaaatctttcttttaggtttacaaagaaaaagcggccttcattttatcccttagacttctgtgtcctccacctgctacattacacttcaagaaatttaacttatatcaatcaaaatttgcttcttaatggatgtacatctcaaactcaatagcccaccctttacaaacactgtacaacccaatagtgaaagcaaaaaaagctatgtagttatttctttaaaaccttcagcagttaagaagaaggagacatatcaaagcatattttttccatctggctccagaactttagttcatgggcaaagtatatggtatttgtattggcaaaataagttgtgatttcaaagcatcatctagtagcactgtaacatagaccatggtgctaaatgaggcatgctagtgaatatcgttcttgtaatagtatcaattgtttcaatatgtaaaactctgtttaaagctatatgttgaatctctactctacttttgggtgtctggccatccaaaaactgaatcccacaagttactaatagacttgaactgaaaactatctctgaaaatagatcaaaaggcacactttgttcaagatgtctcagggaaaaggtgacttctgctctcaaaaaaaaaagaaaaagagaagtgtgtgtgtgtgtgtgtgtgtgtgtgtgtgtgtgtgtgtgtttaaattaaatggctgcacaacctaatggagaagctgcccagacttgccatttggtgggggtgggaatgtgggaggtggttcaaacttattaggctacatcacttcagctggagctctgtctcgatggggatgctaaaatccagcaaccaagacttataccagtaaagtgctcaatgaagatgttctctgatagaattcagtcatatatgaggtactcatttttcctactcaattatttaattgctttaagtctcattttaaaaagtctttttaatatcttgaaagtttacgtaatggttattatgtgcaactaactataattctattccactttattttcatgtaacattattgaaaagagctcataaaccagattccacactcaaaaactcaaattcctttcatactgtatcatttgtttccatacccaacaaaattgtatcttccaccaaccagcctggctgcctaaatgagacttgtgggatgctatcaaaggatagcaatgacaagtgaatgacaagacagaagcttgtcattctgcctcttcagggtgggatgtgatttttgcctatccagaaaccagggggttcatgttacaaatttatattgtttaaagaaatcccccgcaaagtgattcgtggccaaaataattgctgtagctatcacattctcaacataagcatataaataaaatatatgcttacgcttagcataggcatagctggctgattgcatctgcatttttgtacctgcagctaattactggcccaaaaaggaggctaccatccgtcaccaccaaaaggtaggggcatggagagcaactgacacatgactgttctctaatatagcagagctccatctatgttgttgcatgaatagcagagattggagacagaaaacaaacatgtctaaaacaaaaatgtccaacttcctctatttataatctcagtatttatactagatctggtaataagtgcaaggcctactcctcatatactactatcaattaagataagattccattttatccaaagtatatcataccctgtaattctcaaagtagttacaataaatttaaataaagtcaaaatcctttcttaatcttagagcaggaatttttttttttttgccaacatgtggtattttatgcccttaccaaaggcataccaaaacatcacataatctaattccagttttccttgggtttatttcagctttattggtgtacatttgcaaatagaaactgtatatatttgaggtacataacttgatatacatatatattgtgaaatgattaccacaatcaagctagttgacatatataatcacctaacatagtaatcttgtgtgagtgtgtgtttgtgtgtatgcatacgtgcacacacatggtgagaacatttaagatctacattcttaagaaaatttcaagtatgcaatacaatattgctaactatagtcatcagtctgtccactggatctccagaacttagccatcttgcacatctgaaactttcagttttccatgttttaaaacttggtcaccttttgctggaggataagaagaaggaaaagcacatggcactgtttggaggccacatgtaagcctatctttcctcctcatcaaaaccctctgaaaataaagactctttctctgtctttatcataaaggtggaactgcgggtcttgaaaggctctcactgcctcctttaaggcgttcttgcctcacatcagtcagaggaaagagtgcccccacaggccatcattaacctgccaattctgcctccaaacaaggaggacaagagctcactaatttgaagatcaaaaacccacttgtccattatataattggaatgaaaggcaaaatgttgccgttctgaagagcacagtaattactagctgttaattgctctctcgtggtggctcacttttaattaaaaagaacagctcgttgcaggccgataagcaatggtggagaccactggtttaatcaacaaagcagaaaaatttgtttctgctgaagccaacaacagcttgagaaatcttcagatgtccaattgagattaaaaactgtctatttagtgcagtcagattttattttaaccaaggaaatgactatttgaagtcttccaatgtgagtgtccccgccacatccccgctggtgccgtggggactaatcacgggctggggttgtgatcactcaagtaaagaaatttagcgactttcctcttgacttcatcattcttgggtaattggcctgtctgaggtgagtactcttttttttttaaagaaagcgctttaaagtatggaaggcccacagactgtgcatttaattactgttcatatttcatgcagtcaaactgaatttcatttgaaaagaaaatgatttacctatctttaaaaagccttaatgttctgctttgttttgttttgtttttttcttccaggggttatatatttacatgccaatatttagggcaccaaaattaattctgtaagatgcttctctgtcttttcctctttcatctaacagccacagaatgcagctatacttaccccagggtgaggaggtagtccctggaaggataatactacatttagttaagaaggctcccaaggttaagtagagttacttggtcccaatttggctcatctctctgcctttgaacagtgtgtgtatctgcctcccatgcctcttttcttctccctcttttctaagtcatgatggttggaaagccatttgtttttaaaattcacatgttcttccacttaactgaatctcaggctatatttcagtctcgtccttcatcaaggaggaaacttcttccctcttcactaatcataagaaacacatatccctgaattgtctggataatattaaaaatgtgtctcaatcacaatgccagtgatatagactgttggtcaactatctaccctatacattgggtgttagcactagtcttcctgtacaaaatggtttatcactttggctccagtggtgcctctgaaaagatctgtcctcttgccagccactaaagcaaacttctctttctcctcagacaagtctttaagatacagcctataaacgcatgtaggtaaatgggtaatttaatttgggtaatgaaaaattaaccaattgttagcttaatttgctagtccttttctttgaaaacactggtgacgtcaggctgatggaggctggtacctccttcatgccttcattcctccatgccaatctacttaaaggcatacagccgtccctcttagtagggaatttattaattgagtcttgaactgacttttccaaattaaggtgtctgctttcagaaagaaggggtagggaagaaaaagagggttttatagggttttctttttcccctggcttcatttatatccaagaatagaaggcctacaatggtggaaagagcaaagaccaattttggtttaaatccccacttgctttttttttttttttttttttttttttttgagatggagtctcgctctttcgcccaggctggagtgcagtggcgcgatctcggctcactgcaagctccgcctcccgggttcacgccattctcctgcctcagcctcccgagtagctgggaccacaggcaccgccaccacgcccggctaattttttgtatttttgatagagacggggtttcaccgtgttagccaggatggtctcgatctcctgaccttgcgatctgcccgcctcggcctcccaaagtgctgggatcacaggcatgagccaccgcgcccggccccaacttgccatttcttaatacgtaaccatgagatacttgtttagcctcttaaatcacagttcaatccatggagaaaagaactcttttaagagactatttcaaaaactaagtgaaataacattttgaatatactatgtgctcaataggtcatagttgtacctaacatttggggctggcgataaatggatggtaattcaagaagggtccctccacattcacccctctgtatactttcaaacatggcagaacctggagaagaaaatcccacaattattttgttgagtattctctattttctcctatccctacacttcatcactgagcatgtgccattaattgttttaaccgctgtaaaatctggcatgggaatagggtgggacacagtaaactggtgaatgacacaaaaaggaatttgataggaaatttgcttctatagaaaggtgggagtgcaaaaaaaaaaagacaaaagagttattttctaaagtttaagcttctgaaaatttgcctcaggatgttaatatctaatacaaaagaagagtaaacacacatacacactcacacacacacacatgcacaaacacattttttgtgagactcttcttacccagcctgtcaatcctgtaaataagtttggtgacagtgaaataagtgtggtaatgataagaaactattctcatatgagcagcaccatctcctgatgcaagaaggctatgcaactagaaaaataataaaataaaattatttttttcctaaaatagatactttcctaaggtacgtattcaaagttgttgcctctttgatgtaacattcctttctgatcattctactgggaactattacatggcttcttttatttctcactgacaagaggtttttaaaacaattacttaacccagtggaaaaattcaatgccttagttaaacatattcgtcttattcttagttacaaaataagtgtgacgctatagtcatcctgcctatatacaatcatgaaatatcaagttctggagttgaaagagacctaaagagtcttatgcaaatataggcctttaaagttgctaaatacaaacaaattcaaggaacaatgactaaactctacactaagataaatgccgaagagacctgctattaatgtgcctcagggcttcatcttccccaaaagctcagtagaaaaggttccctgtctaagactagaacttggtgttaaaagtgaatggcccatttgtcaggagcaggctccaccagcagctcctggtgtgaccctggataaatcctgtcacttccctgatgtgatgattgatgttcagaagctctgaaggctcatctagcttgaaaaatctatttttctatcaccacttcaaaaaattttttgatcgtggtaaaacatatataagataaaatttaccattttaaccatttttaagtgtatagttcagtgacattaagtaccttcacactgttgtacgaccatcaccattactcatctccagggctttttaatgatcccaaactgaaactctgtacccaataactctgcatttcctcctgcctcctcccccatttcctcctgcccctggtaaccactgttctactttctgtctctgtgaatttgcctattctaggcctctcatgaaagtggaaccatgcattatttgttcttttgtctctggcttatatcccttagcataatgttctaaggttcacccatgttgtatcatgtgtcagaatttctgtccttgttaagactgaataatattccttttgtatgtttacaccacactttgtttatctgctcatctgccaatgggcatttaggttgtttgcacctttcgaccattgtgaatcgtgctgctatgaacactggtgtagagtatccgtttgagtctctgctttctctgcctgctttgcgattcaggaagagtccaagccgactcaaaggcagccggtcagcatcaggcttacgcatctcttgactcactttgtaccacaccaactaccagcagatgctcaaacaaatgtcctctgataacagaaagcagattcagtctctttggatcaattacatgttaaaccaaaatcctcttatagggtgggggcaatctcagacacgtgcaccgtgccagttaaggcaaaagccaagcaatgtgtatatgcacaagcttttctgaacacttacagtcctgtgtctactcacggcatccagatcaggagggctgggatcactgtaatcgattctcatcactgtaaactcctgcattcactctgtgattgggatgtgaagggtcgggggcagggagggagtgtccccccaccccccttatttcctgtttctaattttcaggcagcacctgtcaccagcagtcttgactttcacagttttcttttgagcctctttgcttttttctcatacttgttctaaggtttatcagaggaaacacttgccctcccaaggatggcctccatgctgtgacagattaatccaagttgagtgaacttccttcagacagaggacactaattattatgaaggcacttagaacacaatgcgagctgacatctcacaggccattccctgccaactctgcattgtcttaatgtcagaccctgtcagttcccagccttaattatatcctgtttacaaacattaggcctgacttcagatgaagcattaacaaaggttgacaaaggtcagggtcacatcgcaaggatgttatctgtctatactctcctcccgataaaccagaggtagagggctgatccgagagatagctttcagagcagaaaaatgcagtgtggtcactggaatatctaatctctgcggacacattttcatccaatctgctaaatgctgtggcagggagaggggggcaaatttagagggccaacttggtgctacttatcttaaatcccctgagggcagacatggcaaaggtgttggtaaaaacctctttcaataggaagaacaatcatcaccctttgccactgaatcaagaaactaattcaaagcgttaaaaaacagcaaccaccaccacccaacccctgttaaaatagggacctgttttaaagatgacaagcaagtttgaattactatacttggccttactttttaaatcttattattttcaaatgtttttatattagggtcaatgagcagctaagcagatttttcttaagcaaagcactctttagattcattttatatgctgaatttgtaggtatcacatcagacttgcattcaaattaatcagactcaggtttctttgaatttcagtaagttaaaacagtaattactatcacatacaacccattcttttctttaggttatgatcttagtgatcatctgccaaatctctatattttacaaatgggaagacagtggctcaatgaggtcgaagtatttaacctaactgaatcttacagcacagtggtggaaagttcaggctaaaaccaaaattctctccccctaatctaggattcttcccatacttgggaaattaaaccttttttaaaaagtatttttaggccaggtgcagtggctcatgcctgtagtcccagcactttgggaggccgaggtgggcagatcacttgaggccgggagttcaagaccagcccggccaacatggcaaaaccccgtctcttctttaaaaatacgaaaattagctgggtgtgatggtgggcgcttgtagtcccagctactcaacttgggaggctgaggcactagaattgcttgaacccaggaggcggaggttgtagtgagccgagatcgtgccactgcactccagtctgggcaacagagttagactctgtcttaaaaaaaaaaagcacaaaaaaaaattttttttaaagtattcttacagaagctgacatctatttactagacatctgtttaacaatttctataatttcccccatcagccttctctcccaactaaataacttagattcttttcatcttataagttcctgtctgccaacatgtaaattgctttaaatgttcttttctggacacactcctctaagtcttgaaattcccatagggcacacaaaagcactcagtagataatttatttaactgcttgggcctcatttgtttcttccacagtattgaggcttgtattgtgctaggtccaggtcattttcttatctgggtccagttagttgcaatctgttcgacaggccatctccctaaatgcacagcttgtgcaactgagttccaggtgaattaacactttttgaaatttatctccttcagtctctagctcctccctcatcccccaaccaccctaccataccctgaggccaaggccaagacttacttccaggcctcctacttactaacgctcccaagaaatttcctctgttcccagatttttgatttcttgccaccagtggacaactctgaattgttcagacttagccctatctcctcacatctctttcttcctcatctctgtgagaggcatctatagcacaatgttaactcaaatgcagtaagcgtaagaacaaatctcctccagggtccttctcccagtcctcccatcttggatagaagaaacaccgttctcctcatgcccaatatttacttcagagggtcctttctcagccctagctacttccccatagtgaccaactacatcttgttaactgttttgtccaaagtgcctgccacagaacctggaacatagtaggcacttataatatctgatgaaagaatcaattaatgaatcaatgaatgaataaacttggtgaaatcacgaagtcttgtctatctttctccacagcatcccagctcccccttcccacttcttcctgcagggccatctccacagcatcccagctcccccttcccacttcttcctgcagggccatctccatcctcaacactttcatcaccaggagtctgacttactagaaaccagggttgctatatcaactttagtttctccacctaatccctcctaatcatggctgggcacagacagaagctctgtacaaaaattagtgcttcaatcttaccttaaaaacagatcctttgtgacaattctatcaactattctaatttgttatataaaaatgtcaagtagctctaggcccgggtccaactcctgccaaatgtgacttattttgtttccccgggatgacaatgaaatgctgttaactaccttttgatgatgattctctgaacaggtgtgcaccccataacattctgtggtctagaccagatttcccagcttatggcagattatgtcatttgggacagattccaaggcttggtttaaatagatgtattactgccttgctgttcatgcatcaaccacatgcacacagtgaaggcagatgaatctgcccatcaagtgtgatgtggagctctctgatgacaaactggacttacggtaataaaattgaggttagagtgaaattgaactaaaatccctgggtgttatagtcctttaacttgcttcactcactgtgatgagctgcatagttcagaaggcaatagttactaatagtttaaaaagttgtgctttaagatgtttccattgcagaactgtaagttgtgtcctttttgtgtctgccagccagtggctggaatgctcagtccggaatttctatcaattagcagaggaaataaatgcagcgggtagaggtagaggaggagggagaaaggcagagagaaaaataaatgaaaaaaatgaattctttcctttaaaaccttgaggaggtgtgataaagctggcctttttgcatgcattacatatatattttagtactaagtacaatttaaagatggacaataatcatctgttatctgggtcacactgacacattaatggttctatttgtaagtcttaggacaagatcaataattgagagctttaaaaacaccaggcacacctgcaacctcttcccaccactgaaaaataactgcctgctctttttttcaggagatcattttactttctctgcatttgtaatgccagtcataggcacaacttactctcccatcagaattggattacatcagtggctagtgcatccagaaatacagacctaatatttcacaattgttctacaagggtgtgcacatactttactaccccaaaccaaaaagaaatctaattttagggggaaaggagttgagatggtcataagaaaaccatgtcggtaatctagcacatacctttacatttttgagtgtgaaaatgtccagtgcttaagtgaactccagaattcctaatatgcttacaacaagctgtttaattcaagtgcaagagatcttttctaagtaggaaaagacacactaacacaagcaacatttttacagttcttaagcacagagtcaaaaaaaaaagagagagagagacatcgttttacaaaataacttgtttttccacactcattctgccttatttgttcagtggtgaatggttgggggacagagggagtcggcgactaaaaggtttttggtctataaggagttggaagcatgtgaaagaagaggttttgaggatgtataattaagcagaaatcctcagcactcactaaaaaggaatcaaggtgaatggaggatcaactgtgaccacactgactactgaagccttgaatgccaaaacctttcctttcattcaggcatctggttctaaagcaagataattttcaattttaaacagtgctagatttgattgtaaaaatgtctcttgcatgcgataggacagttgctgtcctcattctcctttcctcagcaccttaaataccagccacatagcagatgcccgatgaatgttcacggaatgagtaaataacccctgaatgggttcaagggtccaaatattgtcttgggttctcctatgtgtcacgctttaaaacaatccctttataatatctgagagccagtatagttttaaatcaacttaccaacaatatacaattcaactcagaaagtaaatagaaataagcaagataattttctgccttactggtcaacaatcaaaaactttttagaatcccggtagacacagtactggataattctgcattaaaagaagaagcagcagatcaagactgtcctcagcagttccacccacatccaacaactgagagagcagttgccttctgagaatgacagtagggagctccaagcggagctcccacccaacagatccagcctcacctttcatttcgccacagcacagcagcagctctcctgtggtcctgcttgcaggtagagagcacatgaggggaaaaaagagggatctggtatgggattgtaccataggccagatcctaaggaacaatattattttatactcctatgacaatcccaactcactcactccattgtgtctgcccatgtttctgagcaacttggagctagccaactcctgtggggccagcagcctaggcaaatagcagtcatcatttattggtacaacgtaaatattcagtacagacatataaagtaaatattattatcaccattttactggggagataattaaagctaatctatttagcaggtaatggagttaggatctgaaccttggtttgtctgactttaaaacatgagaattttttttcaccataccatactacctcctgggccctatcgaagctgagattccagaagagaatgagttacacaggaggcatcatcatctgcattcaaagtaggcatcattttcagatgaagtcctttgtatatatgggcctaacaatttaagctcaaaagattaaaatttgaagacacctaaatatcacaaagtgacaaacattttagaagtctctcattccaccacatactacagagggaagcatctttgtaaaaatatcttgcaagatttacttgtacttataaaaataaattttacatatattaacattcaacatgtattaacattgcatagtacttttccactgaaagagttcaaagcatttttcaaataccaatttttttattcatctgactggggggaaaatgctgaaacattatggacaagctctaggaagcatctcttaaataatctaacttccttcttcccaaaataattcaggcatctcaagataaaatacacataaacactatgactagtcaaatagaagtccaaaactcatgagaagtatttaaggaaaaaaactcgaaaccttgacaatatggtcatttgagcactgaatttaatgttcaacttcatgaaaaacaaggtgaaaaggaaaagaagtatgtcatatataattctcattatctaataaaaaggacttctatggattgttgtttaggagactctgagtaagatattggataatgttttctaccactatttgatagaaaatacgtgaaaagttttcatacgacattacctaaactgaccctcaacaaaaattaagagtatctttaaacaagaaagcaatctgtttcagatataactctattttccttctacatagatcatatctcattgcttatactatgaatagcgtactcaatttctcccatttttttcaagatcttttagttatctgtaaatttttagcaataaaagaatgttcttttttttaaggtaacatctatagaccatttactactgtgtaaccaaagccctgtgcaaagcgtgcattctcttgactcggagactcagggctgtcaaacaacttaccctcagtaccatgaccacatgtgacagacccaagattttagcttgggtctttccaattccagaacccagctcttaattatctgctatagattctcttccatcacatgtttgcaggatttgcaatagttttatctgtgtttccaaagtcaaatagatatgagcgtcttcctggggaattcatattttccttaggtccattttttaagggcagacccacagaggaaaacgaatgctagttgcttctgaccagtcaaagcattgaaatcataacctaaatttaaaaaacctaagcaacgacaataaatattgcaacatgcaggcaaacgaaaaaggtccatgtggatggtaggaaatcatatactttgtggcatgagcaataggaactttcctttcaggtcactgatcaattcagtcagttgaaagtaatctattgtcatcatggataatattatagatgaaatccattggtgatcaaaaaacacctaaaattccatggatcatacaacaacaacaacaacaaaaagcaattaccatcatcattccccgggcaggaagctccagggagaccaagaagtggatgataaaggggccaccaccacctcttaaatcttgttgactacttccagatgagctttttggcatggggagggaatggagctaaagaatcttgcctagctgttagatttcaagtagaaattctcaatagttgggcttatgatcttctagtttcctttgtaaggtaatagatttatctaagcatggtaattttcttactacttttaagcagattgtatctctgaattttgtgaagacttatccaatatgtgcctaagcatgtagacgttttagactataaggggaaaaaagatattgctagcttgtcctataagagggagcagggaaggaaatgtcctctagggcttatgcattagactatttctaatagactatttttctcttcaactcagcctaaaacataccctgaaccctaaagtttttcgataatcttatgcaaaaaaaacctctagaatgactgctattttctaaacattacagtagaagaacccctaagccagaattgatggcagctatgtttctcacaaagacactcccaaaacaagaagagaccagtgaaagcccaaggatttccatccattgattcagtcaggaactgtggtaggtactagagattcagtaacttaaaaatattcagacacatttgagttcaaaaaaagagagaaaaaataagtaaatcgagaaatagcatttgcactcaaggaatttacattccaacagagaagtcagacactaaacatcaaattgtgcatagctatttaattaaaattatgttaagaaaacagttgacagggccgggcgctatggctcacgcctgtaatcccagcactttgggaggccaaggcgggctgatcacaaggtcaggagatcgagaccatcctggctaacatggtgataccccgtctttactgaaaatacaaaaaattggacgggcgtgatggcaggcgcctgtggttccagctacttgggaggctgaggcaggagaatggtgcgaacccgggaggcggagcttgcagtgagccgagatcgcaccactgcactccagcctgggcgacagagtgagactccatctcaaaaaaaaaaagaaaagaaaagaaaacagttgacaggtatagtactggtgttctccaatttaatttaaaggcacttagattcctgggggaaggggagcaataagatgtcggctagccaaaagcattctcctaaaaatgctttttaaaataaagtttagcagcattttttcctgggattatgaatctaacctccaattctggcaactggactcattgttgagtctgggcaccatattaagaatcatggtagccaatggcaacccagctcccataaattcaaagcttcatatatataaaactatatgtactgtatatttcactttaccccagttttttgcttgtttgtttgtttgcttgtttccttgccagcttcacattttacagattctcataataattctaagaatagctctaatatggtttggctgccccacccaaatctcatcttgaattgtaactcccacaattcccatgtgtcatgggaggaaccttatgggaggtgattgaattatggagacaggtcttttctgcgctgttctcatgatagtgagatcagtctcataagatctgatggctttaaaaatgggagcttccctgcacaagctctctctctctttgtctgctgccattcatgtaagacatgacttgctcctccttgccttctgccatgatttgaggcctccccagccatgtggaatggtaagtccattaaacctctttctttcataaattgcccagtctcagatatgtctttaccagcagcatgaaaaaggactaatacaaattccatcttgaatttgacaaccagagtaacaattacttgacttttctgtttcctttctacaacaaatttttaaataaatgagaatgcttctctctgtgtagaatcaaggcatatttttaaaagtagaaaaatatttgtccagtttgaaaaacaactgctatgatctatccagaaccttaaaactatagaatcatattatattggactttgagtaaatcttagaatgaatctcatccagcccttcattttatagacagagactgataatgtgagactttgtgaagacctcagccatttaacccttgagacattaaactggtgtgtatcaaagatatatgaactttgacatggaactactggctgaatggaacccatttaaatacacaaaattgtatgtaaatgaacagctatgtatagtcacaatcaaattagatggtaattcactactcttcaatgtcaggaatacaaagtagttccacaaacagtgtggttgtgatactgtggtttgtactatgtaaaatgcccaattcagtatctggctcttggcaaagactttgcttttaggaggagcccatcttaaaagatgaggaaggcagaacgagcatggcctcttgccccaacaaccacccactgaatcagatgaaacataccacaaggcaatttgaatttttaaaggcaaaacctcaggaagactcctttgcccatttgtttagttgctcactaaaacaaatgctcttgatttttgactgctcagcatccattctccaatcttctggcaacaacagccattttcctttagataacccccccttgcccattcaggcatgttgttcaggtggggttgactccatcctgtctcaccccagactacaacaaagagcacatggcctatgcctggccaatagaagcatttcatcccttgaccacagcaactggttcaaggttaggcacacgacccaagccaggccaaagtctacattcgggacttctgtggaaatcactgggaaagagaaaagcttttcttattagtttggagctgcccagaaccacagtaagaagagagatgatctgagaatgtaaccaacatggaagaaagcaaaagaacaagatagaacaagatagaaagagagtctgagtcttaatgacattactgaatccctaaattcaacattgctgaagccaaatgttccctgaaactcccagttacttctccagtaaaatctttgtcttttatttttcataagtaaatttgaattgggcatttttcttttgcaaacacaagtgtcctgatgaaatactaattttcccacccttcccaacctccctcatccttggacttccaggacaatgtaatgagcaccaaggatctgaactctagctcttgttccgccattttcttgagccacatcctctctaagctccaatgtcctcacaaaaaggggatggaggctatctttcccatttagtaacattaatatggatcttactttcaagggttttgagatcattaagacagaattaatgtcattaatacagaagctctggtacaccttggtaagtatgtaatgctttcaaaaatgaaatgccattattttcttggattatctcatttctcattttggttcttttatccttattcttccatgttattaaatacaaacacaggtcactatttaatgaattgtgttaccctattttctagccatttttataaaaacttaaaatcttaatctcaaaaaaaaatggctatgtggaaaagtgctaagagtgtgtgacttagtggctcagatgtgtagcaaaacaagctttaaagtccagctctgcacccaccccaattgcatggctgtggccagatcatttaatcactctgggcctcagtttgccaatatgttcagcgagataaaatcacccaatttttttgagttgctgtgaaattaaagcatatacacaaggtctgtcatatagatgaagctcaataaatgggaaggacaatattgatcattaatattactagtaagagtgccagaggcaatggggtcaactcggagaagataggtgaggctggagggatgacacagaagtaccaaagaccactgtggcagaacagcttgggtgagtatcaaagacctaggctggttgggtccagagttctggggccagagggtcaaaaacagcaggactatctcttcgttcatagcttgtaaacttccctactccttacagcttttgagaccctgcactttgagcttaccaagctcagggtaagtgtcttgattatttttgtatttctgtcctttaagaagtgattggtaaatgctcactgtgatttgaacatgatcatctcttatccaagaggaaaggctgcctttactttttggtgtccattcccaagaaaaagaaggccagacagagcccacagcatgtactttttcattggaggagagactttaaagttccatttcatgtggttaacccaaaatgttctcatccatctccagatgccctagtgtctccagaggtgtgaaggtcagtggtctgagatgtgtggatcagaccagtgcagcattggaatcacttgggagcttgttagaaatgtatgttcttgggctctttaccaaacctactgaatgagaaactctgttggtcagacccaggaatctgttttagtaagaactccagggattctaatgcacactcaagtttgagaaacactgctccaggtagcaccttaatgcagtcggctattcatatccgtgggttccatatctgtggattcaaacaaccacaggtcaaagctattaggaggaaaaaatgtgtctgccttgaataagtacagaatttttttttgttgttattccctaaacaatacagtaaaagaactatttacattgtattaggtaatataagtaatctagagataatttaaagtatataggagaatatgcataagttatatgcaaatgctatgccattttatgtcagagacttgagcatctgcagattttggtatccgtgaagggtcctggaatcaatccttcacagatacagagggatgactgtatacatgtttttgaaccctgtaagtaaaacttctagcatttccatgttgagaggcaagtggaagctacaattacatccttactcaatcatgtagctcatgttcatgcttctcatggaaaattatttcaaaaatatttgctaaatacttactaaacaaaaaaagtaagatcttgatctcagaccttaaaaagttctagtttcttttcttaagagaccaaagggtcagctgcgggtggaggcaccaatttccatgtattagtcatgactctaggttgcctttttggaggcatgtggagttaatatgaatcctcagtctatatcagacccattattgatataataacagacttagcatccttctgccttggttcatagtgagcaaacctacagctttaaagcacagtaggtttaaactcttaagagccaatgtatgataagtgacctcagaaaagtaagccagatctctctagacccactcagccacgaccaggtgatctcggcatcagcactaatccaggtatattagtcctgggcatttagaaaagattatatgtgatcatatggatgtaaatgtgagaaaacaatgtaaggtaacagtataaggaatagacatggatggtgtgtgtaactcattatggtaaaagaaaccaaaaagaatagttaggtagataatcaatcttctgatgtgtgtgacaaccacctggcacttggccagattttataagtagtgctctgaagtagtgaatgtttttagtaattgatttacacaatttaccccatacctgtacacacttgtaaagaaccagtatttagtgccagatccagcatctgaagacttaaaaatagacaatcctgattagctgtgtttgcaagacttccccaacataacagatgtcaggagacgagtatgacatcatgttatagatgatttttgtaatgtcatcactttgaaaaattaaaattaaggtcagcccagtggagatcttttatcttttctttttatagaaaatgaacaaacaaaatgtgatgatgaatatattaagtagaaatgcatccaaaagcaatttgcccttccagacaggctcagcaaaacaccagcaggagccacacaaacacttgggtactggaggcaaaggacaataaagggtcttgggaagtgcctctgtcctcccttctggggcctataaagagaagcctagtcctttcaagcagtttctccagattttacaacctggttctgctggttgggagagaggatcctcaagaagaatcagtgcatgccaatggcattccagaagatattcgccatgaaaactcactactgcaggtaattttttttttttttcctaagagagaacttctctctggagagagaggaagataggcttaatttgtgcttttacaaattacatactgggttctgtactgcaaatgtgcttaatgaaagaacagatgctcacaactaccacatcgggttaagtacttaggcactgacatggaagcatgaagggcccctgtgtaaccattcccaaacttctttaggctgtttattatctatgcaatgtaagaaatgttttttaaccagaacccctaagttgccaaattagcaaataaaaatacagggcccagttaaatttgattcttcaataaacaagtaatttttcaatacaagtatatcccaaatattgcatgagacataccttctattatatatatacacacatatatatatgcatatacaggtatgtacgtgtatgcatgtgtgtgtatatacacacatatatacacatatacatacctgtatatgcatatatatgtgtatatatattagtgtaatatatatatgtgtgtatatatacacacatatatacacgcacatacacatacatacctgtatatgaataaatatatacacatacatgtatgtatatgaataaatatatatatatatatatatatatatttgctgtttattttaaattcaaatttaactgggcattctgaattttatctggcatcttatccctgaacctatcaataagaaatttctctcttggaactaaatattagcccaggtggaagagaatataggaatgtggaaactaaactttttaatgtgtacagggtccttactttacaactttcctgtgaggtaggaccaaagtctttaatcctcactttacaagtgtagactctgtgttaaagagttgcgaaataaaagagctgggattcaaatcaagatcctctgacagtttgcagaggactctgtcaatcactacactaaacaaacttaaaaaaggaagaattaaagagattggctagaaagggctgctttagcaagtagaaatacctggtgcaagcatggacactcttttctgttttcacgcctaagtaagcaatcatcagtctatgttcttcacaggctaagagtggccattaagaaatgaaagcaagtttagatttcaacagcatgtttggatttgacattttgcatttcaagaaaccaaggtcagctcaatccttttagcactgggacccagataccaccatgatttaagtaaacaacaaccctactgaatttaagggtaagtggtggagtaattgctcatggcctctcttgctttaatttggactatctttatttctaaatccattaaggagagcttcgtttcattctgcaaaacactagtaagttctgtaatgagattgaatttatccttgtgaatactgtcagagaattaaaaaatgagtatcagaaataaaatgttaaccttctcaacattagctgtcttattttccatctccaagcaatgctatagcctgaagaactcttaggttagaaaattatagaaaactaaactgcatacttgtttaaaaaaaaaaaagacatattgtgagattaatctgtccctgataagatattccaaattcaaatctttctctaatcttcctcaaaatcaaatactaagctatatttaccatatcaagaaataacggagtttctaatatcacagaaacaaacttatgtttctcatctgtttattcatttttagaagctgtgcaatgagtaataattgcctatgaaaactgcctgtgaagaatattgtcagaaattccaaactgctccagagcggtggcaagaaagtccagagattattattgggtaatgacattggaaataaaaaagtatatagtattacagtattgagctattagagtaaggaatcaattcaaggagacaagcaaaatttatatactttattgattttaaattttacatgctctgctatgtgagtaaatctttcgtagtaattctaaagctttgaaacattgtaaataacagggactgtagggagttcaggacagctattttttcatactgagagtatatagcctttaatgcatattagaagaaattggagtaatgaaataccttaaagctaacttaagtcagggttgacatgttttgtttggttttgttttttgtctccaaaaagagagcacgtatcaggtagtgaagtaattccaggtagcattctacttaaggaaaagcatattaaattgatcttactgtattacataaatccaacatatcctgtgtaaactcagaaacaggtggctctttgtaaaaggtggctggatgcagccgggcgtgatggctcacgcctgtaatcctagcactttgggaggccgaggcgggtggatcgcctgaggtcaggagtttgagaccagcctggccaacatggcaaaaccccatctctactaaaaacacaaaaattagccagacgtggtggtgggcacctgtaatcccagctactctggaggctgaggcaggagaatcgcttgaacccaggaggtgaagttgcagtgagccgagatcatgccactgcactccagcctgggcataagagcgaaaaccccatcttgaaggaaaaaaaaaaagtagctggatactaaccaatagcagtaaagttttctcacacaaaaacaaatgcactggaggaaaacactgaaacaatagttgactcaggattccatcaccgagaattagattggatttgaaataacccttctatgttcaatgttgaattgaaaaacctcaacgttgggccgtcggagagcctttttccagataggcgtttgagtaagccagtcaggttcctggacagtgccatttgtattaaaaagatcagttttggtcatttgtaactttcaatcatatatataatatacaaaatgacagacatgaaggaggtgggaggagtttgacatttttattgcaatgaggcctactgacacttaggaaaacgttttgacacattcaagtgtgagcaacaaatctgtccactgattcataaaccacatgtttacttaaagaagcctggtccaataaatgaggatcaaaatttcaagtgcttaagtccataaaattccctaaagtgaaatagtgtcagcagaacacattttgaccttcttaagatgagtaaagattttcaaataaatgcacagcctgcttatattattctcatttctatacaatttgttttatttttttgtatctgtaccctatttttttttaattctgagaagccacaaatcaacttttcaatgtttaaacttgtatgaatatgtgagtgcagtactcaggtaactaagccctgactactttttgcaattttgacttatatttacccagagcatgtcagtatgcttgtttggaagccctattcattacaaaggtttatttttttttcttgttgtgccactcctcacacactcaaagctatataaaataatgattctacacatttgcaaagacctaaaggaaatgttggtgatcctaaaacacatcacagtcagatgaaagaaaactggttctgtatttattaaaaagagacgagtttcgtatttcttcaggcttctaatgtgagctgttaagaatggaaatcaaagtcactgtaactattaacacttaaaagtgaagcaatggatcattacagtttcttaaaatggaaaaccttctcaaaactggatatttcgaaccaacctaccaggctcttatgctggccaccagcataggcaacctttgtatgttggagaaggagggggaggaggaattcctgttagcagagggaagtgagcaggaatggtataggagaaaaagaaaagaaagaaatctaactcaacaaccttgaaaagttaattcggaaactttcgttagtgactttggacttcattaaactccatgtatcactatagcagcatgatctcaacagtttgaaaggtatttgtcatcagcaaaagaaaaacattatttttaaaggagtaaagagattgatgcatcactatggactacttaagccccacgcagtttcagtctttagtattaatctaaacgtgatggcttttacatacggtgcataattaaacattttcttttcagggctttatagaatccccatatgtttttaatggcatcatctgaatgtttttcttaataattctggcagcctgctcccaaatcttcatgtttgttttttgttcctaatatcttttctacagaggctgcattgtgccagagattgaataaagctctgagggcctatggttagagaagacacacacacagacacacacactcacattctgcttgctcctctctctttatttgcaatctgtattgctattggcactggaaaaagatatgtgagagagagaaagcaaggaaaaaacacaggagcctgggtcacagcttcactccaccactgtgatacgggctctctctcttctttggtaggactttgctaactgtgtcatctgtctgtctatagaagtttgatgtgcatacttaggcgtgtgcatgccagtgggatgggttgactttggcggctgcaacaaatggtttccctgacactctgggggtgaacgtgccatgatttgctgactccatacctactgcctcatgggaacagacttcctcctttcgagcagtggtctattttctgagccaaaccccttcagacatgacccataaaacggaaataatgaaatgttcaccatttggcttaggcaaattttgagttgtaaatcagaatcacttccatttcagatgatataaatgtaacccaatgatcaaacatatatacaagagaggacatcgggatacaataataagctgagactctaatatccatgtctacccaggattaagtgcccatagtctcaaacatagaacataagagcctctacttgaagaatgagtaaatcaaagagaagaatgtgccccattgttgttcaagtgtagcttgcatttgctttatcccaacataaatttaaattctggaaattgacaaagataataaataactcacatttgaatcataagtctcctttaaattgagtgtttgaactcagatccaagtttcaaaacataatatttttttaaaaaggagtattctcacattctttccatatttgtcatcttgaaatctgatgatgtgaatgaataaaatggaaatagtaactgaaacagcttccttatgctactttcttcattgaacttcatttatttacagatggccaagtggctgtaaaggcatttgaaactctcctattattaaaaagttagatttatcaaaactttcaaagaactggtttgcgtttcagaattccacagatgatgtgccttaaatagaaacaaccaccctggaaaatcttaaaacatttgcaggcaaacaagagcagaaacaagttatccaggaaggggaattctatggctttctctggtacctctaacattcgttgttggaacttgactaaaacaacaaataatctttaagagcatctcttaaataaacaaaaacactttttaaaaatccaaacctcacttttttcccatttgaattgctgtaggagaatttataatgtggcaaacacagttttttaaaaaagggaggttctagaaataaagtgattgaataaaaattaaaaataaggcctttaaaaaaaatcaattgacattccctgaatccagacaccacttcagctgctgggtctcctagccccagtcaaaggaaggagctgccagagaatcaaagccacagggtctaataagctcacaatccaccagggactatcacatcagaactcctaccagctgtgcaaccttggttaaaacccagaaatacatttcttgaaaggttttgagtcatgaaaaccagcaggacaataatagttttgatcttctatcaacaatttgattgagggaccttcccctattcttccagagcaaactgcatccatgaaaatagcttgatggtatctccacatttgaaacaactctcccgtttagcttgctaacaattgccaaggcttcccatatccatatcctgtagcatttaccaccacaagcccaatacaaagaagctgaagtaacagccagtttgacatccccactccccagcatttcaaaattggttagtaaggatgagatccacctgtagatctaagaacaattccaaatcacagcaacgaagaatttgaaaagtcctaagccaggtgctagctgggcctgattttcatgacttttctttgttcgtttgttttagtaactgagtgctaacctcaccccttagaataaagacccagcatgcccaaagcaagtaaatagattccctgctttgtactggtccagcacccaagttcctctgggactgggcctgccttctcttcatcttcttccatgcaaccatttggaggatattgccccatgtcagacactgtgttgggcactggagagaagaattagaataaataggacacagtctctgctctcaaataactcaaagtagaaaaaaggacatacatattttaagtacagtacaatatgataggggttatagcagaggcagaaacaaattggtatgaagaacaaacatggggattgctaactctgctggggaagaacctagaaaatttcacaaaacaggtgacatccaaggtagcacttaaggctattcaagtggtagaaaaagcagggagtacagaaagaaaggcaaggagggctttctaagaagggagcacagcacataaggctgagcagaggttcccagttgatgtttacatgaatcacttgggggtacttcttaaattgcaaattcctgggtgttactcacagattctctttcttttggtctaactcaaggacctggagtgtgcatctttaacaaggaggtagatctcaggttacactttaaaaagcaactggccagggtcatgaaagcgcattatgtgtttgagggatgcaaagcaatttagtataagtggagcatagatttgaggggtgagaggtgaactgacagagctggtcaaccaggtccaagaggaattatggagtctcccagccacctatgaagccctaaaaatgagattccaggaagcttcagagccaccctcagagctgcaccagggcttggatctagtctctatagctgcaaccacttgggtgtctgccgcactggggtgtcagcagggtagagagagagaggaggagcgtagacagcctaatgtttcaatcccagttctgctacttactgactatagacttggcaattgattaaccatcttgggcctcagttcttcctctgtgatgagaataataactccaaaatgccaaggtcagtctaaaggttaaatggtataatgtccatgtaatacctatctcagtactttactcatagtaatagttttaatagtaaaaatattacctaccatttattgaaaattcagataagcagcaaaaaaaaaaaatgatttcaaatagagggagtcatgttttgcctgcacgacaaagatgtagaatttcgccatgactgagcctctcctgcaggttaccacacctaaatgtcacctagctgtcagcacttcagatagacagaccctttgcctattttctagtgtgggtcccatccctgatcattagcctttgtctagagtttagagctccctggtctgacataccttcccaccatcatcacctgcaaacctgacagctcttcaccagttctatatttcctgatcatacacaataccaaactatctcagtgccattatgacttataagggttggcactgttcctgaatacaattaatttatctgccaaagacacacttaactgtttcatgaggctcctgatctctctagcataaacaaaccaatgcagaggaagagaagccctgatactgaggatggtgaataactttatcctgaatccttgtctcctcattatattaacagtaacaaaactctaaatttaaaggatactctggagtttcaagatatctttttccactgtctctcatatgaccctctccataacctcatcagagaggcaagacatttttccccattttacacatggaaaaatattgaacctcagcgaaattaaatgacttagtcacatggccatcaaactacaaagacctgaacccaggcctcctaactcctggtacaagtgcgctccaatattctacatctgccacctctcattttctgctaaaattgaccttcagcaggagagttaatgactactcatgggtccaaacccttccacacaaatggttacaagtcttaaatcacatgaaaataaagcctgtatagcagtaaagcctaaaaatagctttattaatctacttctgaagaagggattaattctaaaaacattacagaaccaactggattcccttttgtaccaattgggagcagatttggagccacagctggtcatcatggtataggagaaataacaagttttagatcaaaaggatctgggttcacaatcctgacttagccactccgctggatgcatcatcttgggcaagttcctaaagttttgagtccaattttttaatccttaaagtggtttgatcacttctaagctcaagtgtgattatacaacaataaacatcacaagcctagcttggaaatcacatagaggcccttagcaattgttatcccactttccctagaccagtgttaccaaactttaacatgcatgagagctcgttaaaacagtttggtgagctgccccatgctcagagtttctgattcagtgtgtctggggtggaacctgagaatctgcacttctaacaagttcacttgggtaaggctgatgctgatgctgctggcccagggatcacgctttgagaaccaccactctcaagccagacaaaggtgtcatgcagacattgaaatagaaatcactggctagaaatctctaacctagaatggtgatgctaagctactgggtgtcaattgctaacaagcaataccagctaggaaaatagaagagcaaagacccataatcctgactccttcatggacttatcagggtcagaggattccatgctagatgagcactttgtctaagaccccttataattaagacgttcagaatttccgactgaaggacctcccaactccacttctgggaacatgctgccttataaatagcctctgaaaatccctgggagcacctagaccactgcttctgtgaaatccagcatgaatctaattgaagctgcttaatcgaacaccaagttgccctcagtgtgatttttacatcgctggctcctcagttgcttccccacccggccctaccccacatgcacacacaaatatactgaatctgagagtccttcaggagtgcaattaggacagtcatttaagagatgcaccagcaatacctcatttttacacatagacatttttctgaaagagaatcatggattttgcttcttaaagggaataacaacaacaaaaccccagaaaatacgttaaccctattttatgaaggtggtatagacagtatatcctcttttgtttctagatatgaagaatacataaaaatgtgatgaacaggcactggcatatatatcaccctattcttgtgaagaaatttgtaatatatctctattttgctgcagccgatgccactgagtcatcaatttccactgtattatccaatgttctgcttggttggaatattaagcagccatcagattttgaacttcacgtttcctcacatttggcccttcactgatcaagctttgtttctctgtgattatagatatatatcagaccccggaatcaactttctttgttttatcaagacctggtgtgtagtaattctgatttatcatttttacaacagtctcttccctgcgggctccaggtcgtgatggtggcattgctacgatttatggtggggactgttgacggaaaatgtatggtctttttgattttccttctttccaacacctggttcttattttcccaactctagcttctgccattttaagcattatttaccattcgctgaaatgcatgggtctatttggagggggacgtgtaaggtaaaggatgaattttcacagttggctatgattttttcctcttatcaatgacccagtgctgatttttttttttttttatttccttatgtcgttgggggcctggagttcatattcatttctcacttgcttcttcttatctgacacgacttattagttctctgagaaggaaaaagaaaatgcaggctgggttaagttcctcacagaggtttttgaattctgcctgtgattcacgctgtaggtggtcacctccctttccaacctggataggttatttattacttactgaaggctcctctctctccaagtcccagagcaaggctaattttctttagagtctaagaagttatttcagaataacttggcaaaaggaagagtttttaaagcctgatagtaatccattttatttaccaatattgaagaaaattgtaaaagatggggatgaaataagtaaagttgctcacacctgagaaatgtttgatttttgaagactaacgtttaggtttccctgccaatgcaaatcaaaaaccaatcaaagctgtttttctaccagagatacctagagtgcttccactgtttttttgcctcctctcctgcacccagcagatgcactatgaatttcttataaaaattgatttgtatttcctcttttaaccaaggtttcttttgttaatctgtatacttttccaagaggccacgtagtttgtggtagaattcaaataggaaaaatacttaacatcccctccatctgtccttctactcattcctaaaaatagaagtcaacttttcagactaagatttttaaataaaaaatttgggaaattggtcaattacatatgctctggtagagatagctaataaccccctggataaagcacccagacatactgattttcccaggacagttcctgtttacgcttagtatcccagtgtaatcagtggtagtggcatctttcactgtcataagtgtgtcattttggataaaaattatgtggtcatactgtcctgtatccactccccccattcttccttttattaaaaaaaaaccctactgacttttatttgacaggacacttggctacccatgtagaaactgcatttccagtttttcctgcagtctggtatggccaattatttacataatgagcaaactcgtagtgcttactatttgccaaccactgtcttaggtcctctaccaactaacacatgcaatcctcatcccatgagcaaggtgctattctccccatccctattttacagaggaggaaactgaggaacaaaaaggctagaccacttgtacaagtgggatgtgctgggatgagctgggatgtgaaccccaatggtctgactccagaatctgtgctctgaacctgctacctcggagtgtgaccaagtttcagctgtgagaggaagttgcatgggcaacctctccatttagtcccgaaagggaaatgtcgttgtccccagttctttcctttctctttcactcaaggaggaacagggacttggtgctggtgaacgcagaaacaactctccaggagctggagaagccacagacagagggatctgaaacctgggccaactttccctgaactgcctacctccctctatctaagccgctgccagcctgtaccttaactaatatgcatccacatccccacctcaccaagtcccacttgatgcgaaagcctaggcacccattggagtcaggcaatgggaagatatatgtgaatattctattccagtatcaaaatcaatcctcttgaccagaaacagacattccatcccattggccccaagagtcctattcattctaatagttgctcccataccatttttgagggatatttcaccctagttctatatttaattctagatacatagaaaaaaaatccatgaaaggcaaacatgaaagaaaatataggtagagacatgcagcctcagcccttactttcaaatgtctaggtgccacctgggcctcttccccatcctaaagtcgttccagagcaaagcactcaacacaaaggccttcctttaccactgtatgaaacagaactctctaccctagccttgtggcatccccttttctctctcccctccttcatttttctcagcagcactaaccaccacctgatatatgttaacttcttcctttatttatagcctatcccatctggattataatctcactggagaaggaactgtgtctgctttggtcactgctttatccccagctcctaactgagcctgatatgtcgtaggcactcaataaatattgattgagcaaatgaatggagaataagcagactgtcaacagctgtaactatgtgacttttgggttacttaacctctctgggtcccatgataacagtgtctaatagggttgttgtgagaattaaaagagatcatatatgtcaaatatagaaactaccttccagtacatggaaggcccaatatcatgttaagaataacaactaatacagtgctcactctgttcagactgtgctatgcactactgtttcatttaataacagcccatgtgtttagaatcacccaccttctggtaccataacaggagtcctggttcagccaccactgaaccttgttctgtgccttgccttgttctgtcctctttctgggatttcctgagacaaaccagacagcaatttccagaggtaggacaaaccccaaccttctttagtgaaacccaggtcaggagttgctagaactggtcttgcctttgataaacacagcaaaatagtattattttaggattaggaccatatctggtgtaaaagttagtggatttggagctctgtttgttaaatgtctctccttttttttttttttttttttggtattcctttaagatcagcattggcatcttcccactaataacctggggtatagtcaacttattctttctttctggacgttaattcagcagaccctgaatagtacaagcagaccctgagactgaatcctataatctggaacaaagctactatgtctgacacctagctaggtcataagacctctttccaaaaaaaaaagaaaaagaaaaaaattagtggagctagagttctgaggatagcagatgtttaaaaaacaaagtagcaggacaacttccaaaggggaaaatccacactcaagctctgtgatatctaactggccacttgcaatggatagggtctccttgcccaacctcatgcttcaagacctcagctccttttaattttaacacttaccaaactagaaatgatctagaggataatgacaataaatagtagcagcaggcacaaatttgagtgactaccttatacaggaactatgtgcctgtaattgatttttctaacattatttttcaatctcacaatcctaaaagtaagctactattatttttgttgttcttattcctattttatagatggggaaactgcagctctgagaagttgttgctagcacccaaggccccacaactactgaggggcaaaatgaaaattctaatccagatctttgtaattcccatgcctacaccctctccactggatcttccaacatttagccccttataattcctatgggcaggacatttcacacatatatttctggacacttcaatactaaaatgtgaaagaactgttcaaactttacccaacaagaagaattatttccccatgggacagcctctggaatgactgtatgattccattactcatcccacaaatgtacctgcagttatagtttcattctgtggaatgctggggaaccctgcctgtatctctagcatagccattagtattagaaatgtcttactagtaagctcctctttgtattttaccatgtattgggtggctatttcagaatgggtcaaaagcaaacaactttaccttatttccctgaacctcaacgtacacatcctctgattatacaccggcccagataaatgaaatcagagacataaaagtagattcatcctgaaactccctaatctcataagtagtttttgttgacaaaagtttttgttagtgaggttccccctcaaaacctgccaatgttataattgacaggctaaagttagtgtattccaggtctggacaattttaacggtcatccccttagccctggtttaatatacagtgctggaaaacaggccagaaagtgagtatcttagatatactgatatagtacatgcagcagaacatttaaaaaaaaaaaaaaacttacccaaggaattcaaatcctatcacaaatgcctttttcttttactttaaaaacaaagtaaaaaaataaaacttgagtacaaaggtggccaggcttggctgacagggttgataatactgggatttaacaacatggttgttcacaacctataaacctacttctattagttttataattataaaacgattacccccaaactctatagaagtataacctgttggaggctctggcttcacatttgcattatctgaggggattttttaaaaaaataatgatacctggggtcctacccttagaaattctgacataatttgtctgagatggggtctaggcatcagtgctggttaaaagcaccccagttgattctaatgtgcagccagtgctggaagccattattcttggcaactctctattgagattcagccacttctctgtccccatcacatagctgtaacttgcctccagtcaaataaaacttcagataaaatctcttactgccgaatttctttctcttttattctaactggtgtgttcaatttttgcctaattattcacctactttcttcggattgggcccaaggtatactttttttgtgacaacccaaaattctctccacactatgacaacactaattcattggataatcccttaaaatatcacacccacttttattgttcataaatggcaggttagagggacatagattcacttctgactgatgactaagtgaaagcaagtgactacaaattccctatcctcagtttgcaaaacagagactgtaatatttaatatttttgaaatctcaaaaaaactatagtacaacacaatctgaattcaaatcacagtcttctgtcaactgaattcgaatcacaatctgctgtgtgacatttagcaaatcatgatccctctcagagcctatgcttactcagctacaaagcaatggatttcttcctcccagagtagatgttgaggctaggattctcttgtaatgttgaagaagttctgtatctaaagtcaggagtaactaactactggtgagtgcagtgacattaatcagttggtggtgcttgaaactatattctcttgccacccaccaaaagagccctattcaaattttgttcaaagcaagagaagaatagagttcttacatttcataatcagggaaaagtaccttcactcctcctttgaaagtcctatatatgtacttataacacagagaagactcaagtcctgtaaattagacatttatttcagaatttgcattttcactgaaataaatattttatagattccaaaaaaaaaaaagaaatagagggcacctgaaacaacctcttcatttattcttctatatacatatgaaactagactatccaggaaaatatagaatagctcgttgttctttaaatatattagcagatgggttttagcaacttcacttgatctaaggcttccatggtggatttgttgagtaatcttcactcaaatcaacccaaattctgattgtgctagtttcctctcagaggcctatgattcatttgcctgtgtatcctcaaaagattttattaatactaaagagccctgattcctttaggccttccccataggacctcaacttctaaaatttcctttgaacctccaccaagctccacaaatttcctacctctgccttatgttttagagtctcttctgagctccaggacaactgcttctaagacatctcctcctggacatcaaactcaacatgttcctgccatgctatcctcttccagtgtctgtctatgttcataaatgtcaccaccacccactcatctccacagtcaaatgttcaccaagaactttgtaccctaaatatgttgtgaattcttccacttctttccatttccactatccccagtgcaaagactattctctttggatactataacagctcccagctgatccctcaagatccatgctctgcccagtagccagagtaatcttttaaaaacgtatatcagaccacagcactttcctatataaaacccatcagtgactcctcagggtcctcataataaagatccatgtacttaacagggccttcaagatcctgtgtgacaaaaccccctaccctctacagtcaaatcaataatcacaagtatgcaactatagctacattaagtgctatgaagaaaaatgaagagctacaagagtgtaaaaagaaggactctgaaactgccttcctattttcctctggtggagctctttttgcttcatggctgaatcctcctctgtttgtcccataaatgtctgcatgccagacttccgtccttatcacactgctcttctcatgtacgctctctcttcctgtgccaaggactcccacatctgaatcttcaggcctcattttccagctgcctcttggatatctcccagatgttctgtaggcacctaaaagggtgcattcccaaccagattaaatgtctttctccaattcctcttctgctgttacctctcaccattcacctgaactagaaaataaacacccctgagatttttttctccctttccctcactcccacaaccaagcaggagttctggcattctgccttctaaacatcttgtaacttggcatgttctccatgcccaaatgccactacttttgttcagacatgtgttatctctcccctgcattagggctgcagtctcttccctggattttttgcctccagtctcccctaactttgatcatttgctttgctgccaccatgttcaatgtggccatgtcatggccctgcttaaaagcttctagtgcctttaaaataaagcccacattcattagcttcataatcagatcctgcctatctctcctctttttttttctttttcattcattcttttcacaagtattcactgatcacctactatgtagatggagcagaaaacattgctacatttattaagcccatccccaggtgctgcaatatacccacacatttggcctccagtaacttgaaatctcatcattttctgcacatttcatgttctttcaggctttcatgtaatacctccatgggctgcaagacttttccttcctctcaaacatatttgtactccttataaagactcaacactcaaatgtaacctccatgaagccttgtgagagttccacaggcagaattaggcacactccttggcacatcaaaccactttgaacacatctcttccacacatctgtctccatcactaaactgggagcccttcaagagcagggtaccatcttcttccagtgcatatcctgaataaatgttactgatcatatgaatttaaaaataaatgaaccaatccattctatttcatctttgagagcagcagtccacaaactgtaatgtgcattagaataagctgggagtcttattaaaatgcaaaccctgatttggggtgagacctgagaatctgtatttctaacaaactccctggggatattggtgtgtgggccctaggactatactatgaggggcaatgttttagaacttgatcatgaaacacacaaagggagattagttgagaactgagaactgttcttgcagaaattgaacaaaaaatggttcagtttcacatcttttctatcaaatatgcatgacatcttgacagcaaccactttctgaagtgctagagagaaagagtcattgttgtaacccttcctcagttggaaagcccacccttagctctccagatcctctcagaagccctgactgaagctgattcactagccttgcttgttgcagaagcccgatgctggcatttgtttccaactctgcgcatggctcgaatgtgctcccttgtcatctacagcatggatgcaggaccccaaatttccctgccaagagttggtggcccaggacggctcagtgcctctttcaccttccctgttctaaggcaacagccctggctgccattccggatgccccttttcaagccgtcctacctcactgagcgaggccttggcactggctctgctgcattgtcctggccagcacacctcttatcagcccagcatcctctgtgctcttgacagtagcctgcaaagactcacagaactgcccgaaaggtgatcccagttttagttaaaacttttcctaccctcagaattctgagatgctactggggatttacaagttgttttaaggctttttaaaagacaaacccacggtatttacatagatatatgggtctgtgtaaagtactgtgcagttctttataaaaggtgtagtataaatgttcttgtattactagaaggattatataaaagatgttaaaacgtatttctactaagcagtgctatagatggccacagaatataatgtatccattgtaaagaaatccccaccagagacctctgaaatcttacattgattgagctgtgctggacctaaaacgcattgaaagttttccaagtggtaaaatattaaatatactcttttttaaaatatttaccagttaaacactaaagtactataactggctgacctttcacagcagtttttgttctacttttccaaaagcagccaaaaagggattgttttcttttaatgttttgttttgtcttctagaaaaaaaaaaaagaacagacttattttgagcaatacgactcccccctccgcctatgcaataacatcataatggcagaataatcactgtaaacaatgccctggggatttagttggctacaacaggggactctaggagccaatttcagtgcttttcttaactacatcattgcatttttgtctgcaagtggataagaagagtctccttttagagcaggttgatggaaagtgctaattgttgacacattagctaattgttatgattagcccctgacttcttttttattctggaagtcaagatctcaactgtgaagtatgaagatgctttatggcaacaatgttatgaaaacattcaaacaatgagaggctaatcttcagaagcattcaatccggtggcaactaaacagccatgcctttaaagaacagacaactagcaggaaaaaaaaatatcctaactgctgcatccacccaatatttcagacataagtattctggggttatcattaatgatctgtttttacaaatctactatgtctttggaaagttgaagcaactccaaaccaaataaaccacacgcaagccataatggtccactgacaattgaggcagcttggaatctgtgataatatgaacttgtaaagtgccacaattagatgtttctctattttccgaaagtcaacatgggatatttgaaattgggatcattctcaaccatagttcaacttgagaaaacaactagttacgaataccaaaatgtgcattatttttttaatatttagagaaaagggaaaaagaggaaatcaagtagagagaggaaatatcaagaaaccaaatcacagagtccaattattggctctggccattgaatgggtcattattccatgccttgtccacctgacttataaatgcaagcaaatatttattatttgatgtaggaatacactggcttcttataaaaaaaagtatttgagactgggcacagtggctcatgtctgcagttccagcactttgggaggccgaggcagaggacggcttgaggctaggagttctagaccaggcctgggtaacataggaagatcctgtctctacaaaaaagtttaaaattagttgggcatggtagtatgtgcctgtagtcctagctacttgggaggctgaaacccaggtgtttaaggttacagtgagttatgatcacaccactacactccagcctgggtgacacttgctctgggtgacagagcaagaccctatctctggagggaaaaacattatttgacgaaatttcaatttaaaagtaattccagacaaataataaaatcaaaacacaattctaacatgataaaatgtgttcattttatattttaacaaatggagaaagtacagacaacattcttaaattattctgtcttataatctcccttatataagataattatattttacaatccatccattaatcagtatctgtacattttcttcctacagggatatttcctttaaactttaagtatctgcatacttgaggggaaaaaatcagttttcaataagctgctgtttattgatttttatttatttatttattttgagatggagtctcactctgtgacccaggctggaatgcagtggcacaatcttggctcactgcaacctctgcctcctgggttcaagtgatcctcctgcttcaacctcccaagtagctgggattacaggcatgtgccaccacacccagataatttttttgtatttttaggagagacggggtttcaccatgttggccaggctggtcttgaactcctgacctcagaagctgctctttattttgattgtacatagtttgactattttgagtgacttaactggttactaactggttatcccagctagaattgtttacaaggctaaatgtgatactaacttaatgtgagtaaagcagtgcctggcacatatgcacccaataaatgttagctgccatcatcatcatcatcaaagtgacaagtaactgattaaaaagtcagactttcatttatagaaaaaggcatacttctttgggtatatacccagtaatggtattgctgggtcaaatggtatttctggttctagatctttgaggaatcgccacactgccttccacaatggttgaactaatttacattcccaccaatggtgtaaacgtgttcctatttctccacagcctcaccagcatctgttgtttcttgactttttaataaattgccattctacacatgaacacacatgtttattgcagcactatttacaatagcaaagacgtggaaccaacccaaattcccatcaatgacagactggataaagaaaaggtggtgcatatacaccatggaatactatgcaaccgtaaaaaagaacgagatcatgtcctttgcaggcacatggatgaaactggaagctatcatcttcagcaaactaacacaggaacagaaaaccaaacaccacatgttctcactcataagtgggagttgaacaatgagaacacatggacacagggaggggaacaaaacacaccagggcctgtcagcaggtggtgggcaaggggaggaagagcattaggacaaatccctaatgcatgcagggcttaaaacctagatgacaggttgataggtgcagcaaaccaccatggcacatgtatacctatgtaacaaacctgcacgttctgcacatgtatcctggaacttaaagtaaaatttaaaaaaaatttttttaattaaaaaaaagaaaatggtatacgtgttcccaggttaaggtaagatgtaacacagcattgtacatggaagaaggtattatttgtatcagctgctaaatgtttttgttgtttgggcattggtttttgttttctgttttgtttgttttgttttttcggtaccccatgaccagtcaatagtttgttgaacatctattacataataggcactctgctacatggcttagattagggctctgtctacatacacaaactgagctgaagtttaaaaacctaacagaaactgtagtagtctctcctcaatttaaacaccccaggggtataatccttagctcctaaagggagaataaggttggaatgaacaaaggtaagagggaaatcttggaaaggatatatgcaagcccttataaaggactgagcaataaaaaataaagacagtacacaaaaccaagataacaacatcagtgaactctttctaccctaagtttgtaataattaaatgaataataacttttttctctcttgttagaacctccttaggctctttcttctctacagtttcaaccggatatttcaaattcacttagctttctttcaaagatcacaataagaagacatctctgtcctggtccagtcctgcatctgacatgagtgccactctgcctgagagtcaatactgattcccaagtctgtgccagagacacagcctgaggcacatcccttcctcttccctgacatgaatctctgctgccacttgctctgaccatcccttttggtttcctgccaaacctcctcccctgctctacaaagcatgtgacttctcgcttctcttcccaatctctttttttttctttttctaatggccctcaacaggaatgatttgagatttatatatgaaaaccaaaattcttcccatagtgaaagttatattcaaaagtaaagcttcatgtaaaggaagcgctaggttgaagagagattactgtaagggaactaaatgaagctattattctttaatgtattattgaactgagccaataattggctttttagtttaattcaacttgttttcctaccaaaatatagattctatgatcctttatttctaattcttttaaaattgtatatataagagcctaactgtatcttactctatatatgctcttctgcagtcgtggcaattcctgtctatctcttaatttaccttaagtaagaataacacaggaataaaatccctgtatatgttaacatattttctaaaaatatattaatggctttctttacaacatgactgtaaaatatacaattttctataaatattcaagtatgtgttgggatggaaggggcttttaaaagcacatattattggtagaaaaagagaaaagttaaaactcacctaaatcaactcccctcacctaacatatgaagaaagtaatatttaaagtggtgaagtgactggtccaatgtacacatctgaccttggcaggcccacagagtttgcacatgccctgcctcctacggaaagaataatggcatgtggcactggccacttcaagatgcagctctcctggtagtgtgttggactgtatccaaacaacccaaaacatgagacaagttagtacaaactggctattaggtgttctacttccccatctctaaagaaagaaagaaagaaagagaaaggaaggaaaaaaaatacaatacaatctaggtttgttataaaagtgtttgtttttaactctacttttgaactttttgaacttttcaaattggtttctggtatgtactatctccaaatccaaagggggttcctagagctatccaatatgtgatggagctgttgaaagaacatgaattcaactatattaattatgacatatagtcacagttcaattacttccaacacagtataaattttttataaaggcagaaaaataaaaatggtcaacatcctattaaagactctgtattctcaaagatggtcatgctacctgatatagtttgactctgtgtccccacccaaatctcatgttgaattgtaatccccagtgttgagggaggaacttgttgggaggtgattggatcatggggtagatttcccccttgctgttctcataatagtgagttctcatgagatccggttgttggaaagtatgtggcacttccccctttgtgctgtctcgctctctctctcctgctccaccatggtaagatgtgcttgcttcctcttagccttctgccatgatcgtaagtttcctgaggcctcccagcaatgcttcctgtacaacctatggaactgtgagtcaattaaacttctttcctcataaattacccagtctcaggtagttctttatagtagtgtgagaatggtctaatacattacccatacatgccatatgtgtgtataagcagtggtcatgttctcagaagaacaagtatgggctttggaggcaaactaatctgggttcatactccacctctgccactctctgaccttctttgggaagttatttaatagctttgaccctatgttatcattgtaatggattgattggtgtctcccaaaaagatatgttcaagtcctaattcccagtacctgtgaatataccatatttggaaatataatctttgccaatgtaattaatttaaggatctcaagactagatcatcctggatttagggtgggccctaaatccaatgaccagggcccttataagagaaaggggagggcaactggagaccagagatccagagggaaggccatgagaaggcagaggcagagacaggagtcatgcagccacaagccagagaatgccaagggttgccagcagccaccaaaagccattaataggagagaagcacacaatagactcgcctcagagcctccaggagggaacaaactctgcaaacacctagattttggacgtctggcctccagaactttatttactattttctttgatggagacatcagtaccaatgtattaaaggctttccaacccaatttcattatcttttcccctttcagaaaaaataaaatatatcgcttattaaaacataagaaactagaccttactcaagtcttaaattaactactaactaatgatttgtctacatatcaaaggaagtcacacacacacaaaaaaaaagaaagaaaaactttaaaaatactgtgaaattgattttgtggtttaaaaacctaatttgaagtggtttatttttagaatgccacctttttctctatttacttaattcaggaagaacccatgtgcaagtagacacagccagatggtttggcagtggtcttttttcctttcattcccttaatctcccacttgcaaagtaaagaaaagcagcagtcataattggttggccctatatgattcataggtacgcaattaatagctgcagcaaagataaagcattttcagtttcttggaacacaagctctaaaaagtaagagggagctaaaaccttaacactcttttacagaagggaataaacctcctgcaacatcttccttgttttttcctttattcaggccgatagtttgatgacttgagaggcatactacagttcatgaaagggacaatagagaggtctgcatcccctttgaatgcagacgtgtaaatactagaggagataaggtagatgtccctgcttgctggagccctctctccatcattcaggccaaaagaacaggaggagagacaagtgtgattaattaagctctgttttattctgtgctccattttaggttataggtttacatatgttaggcactgggtactctcattaattataataggtacatgtcattttctccttcttacaaatgtggtaactgatacctagagagcttaaataacgtgggtattccataactgggccataaacacgtaaaactgacatttgtctctcttttttttttttttttttttgagacgaagtctcactctgttgcctaagctggagtgcagtggcacgatctcagctcactgcaacctccgcctcccgggttcaagtgattctcctgcctcagcctcccgagtagctgggactacaggcgcatgccaccacacccagctaattattgtatttttagtagacagggttacaccatgttggccaggctggtctcaaactcctgacctcaggtaatccacccaccttggcctcccaaagtgctgggattacaggtgtgagtcaccgtgcccggccgacacttgtctctgtataacttcccactcccacttaaaagaaaggattcaggagtgaccaagaaacttgaacgtggttgttgatgtttatttgaccaaacagcattaaagagagagtttcactgtaagtaaagaaaaaaaaaaaaaagctttctggacttaaatctgattacaacacattttaaatccactgaaacttatcctgataccaaaagacaagctttgcctatgccagttctcaaagctttgaaaccctagtcatgaagcagcaggtgtggactgccttagattgttctgggggataaaccacactcccccagtgccacagcttgcccaggattttccctgtgtcctcgattcttcatctgcctgaggcccaccttcttggagaagggacagcacagaaaagattacatgtcattttttaaggccaagtaaggcctagtagttcaaattaaaacccagattttcagcatagcttttctgaaataagtgttcctgtgagaatcactagctcctacattgttgccttgaccctcataggcttatgagtgaggaagtcctctgggatgtggcgctgtccagaagcggattcaaaactaatgtaagaaatagctttgacctttagagagcttgaaatctagtgggcagacacagcagtctattagaaagcaattacaatttaatcctcaccattctggcgcaacctctatcaggaaaggtgagaaatctccatacggattggaaagataaggggaaaataaggaggaaaggctagcttgagttagactttgaatgatgaggaaggggatttgaaggatgaggagggaaggaattagggtaaaggaagataactgtcattgaagagaaagtcataaaaattattacagttattacagtttctttggcaggcagagaaggaaggaaaagttgaacaaaacgagcaaatgcaaagttatgtctactgggtctttttccaggccaagataccccattcacatcctgtacttaactcacttccacctggacaggctcctgaaaggttaaaggctcattttactctccacaaatacatttgcctaatttttacagccatttacacagcaggtaaacaaacttcttgatccaagatgaaaacgtaattgtcacccatttcagtgaagaagtgaaaacagtggttgaaagttaccagcagagcatgaatatgagagcttctagtgaagtaacagaaccaggctacgccacaaggaactcaagaggtgtgctggtaaatttcagtgttctacataagaaagcattacctgcttgtgcttaagaaatatgcatttcagtgggcagcaacagaacaaaatccttcaaagtttgtttcttcaactagacatctgtggatacaattatatatacgatttgccacagctcacaaaattttatgattacctagaccccaaaccaaagcaaggtggtaattctgtgaaaatgaaagtttccatcagatttctgtcatggaaaacaaatgtggtctttataaatgagagacaggttccctttcctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgccctttcctttttaagtgatgtctgtggtggagaggaaagccactgtcagtcatgaaacgagttgacaattgattacacctaaataatccactgacttgagagtctcttgatcctgtatatcctggcttcctatctgctgtctacttctatgtgcaccatccatccagccctccaggtcttaacacatctagtaccccattaagagtctttcctaaatgtccagtggtgatatccaaaagagaagacaagtaataaaagaagaaaacaaatatctacactttaaaaaaaaaaaaagtcaacttgaaatgccaaaaattctcatccactcctcagaatcagaaactatgtttcatttgtcttggtttacgcagtgcccatcacaggggctgagacaaatactctgaagtgtttgtgaacaactgagagtcttttctaggaatattggaatcaaatgacttctctttcatttccaatcaagcaaggtcaaattaatattcaaatattgtaccttaaatatttgggaatgatgcagctcacttttcaagacactttggcactttttcaaaaagttaaatatagagttactatgttacccaacaatttcacagctaggtccacagctagcagaactgaaaacatatgcccacataaaacttgttcacaaatattcacagcactattatttataatagctagaaaatggaaacaatacaaatgtcactcaatgaataatgaataaacaaaatgtggtatatccatgcaatggaaaattattcagccataaaaaggaatagagttctgacacatgctgcaatatggatgaatcttgaaagcattaggctttcaagtaaaagagacccaaaatgctacatactgtgtgattgcatttatctgaaatgtccagaataggcaaatccactgggacagaaagtagattagggagggataatgagaagtaactgctaacaggtaaaggcttctttttaggagatgaaaatgttctggaatcagacagtggtaatgcttatacaactttgtgaatatactaaaaaccatgaaattgtatactttaaaaaggtattttatggtatgtcaattatatcacaataaaaagaaatttgagaaacctcttggtgaagaaatcgtagtcaggatttatgtttagttcttcaggtgtgatgaaaactattaatagtctatgcattctttttttctttgtcaatagatattttgataacatcatcaaaattcttatacctacaaaagccctttggccatttattatataattaatcactttaaaatagcaagagtaataataataatagcaactaacatttattgaatacttactatacattggtcactgttctaaattctttgcatgtattaactcctaaaagagttaaaagaacaactctataaggtgagtactattcttctctctatttaatataggaggaaactgaggcacagagagcttaccacagtcacacagctagttagtggtggagccaggatccaagccgacacagcctggtccaaagctgacactcttaaccaccattcaatccacctttaatgcaaataggaaaagggttagtgttgtagaaagagtgctgggtgagtcactgcaggcccaaatccagagactggtctatgttttgccacttgcaagctctgtaagaccagtatttccttctagcctgctcctcctgatttttaaagtgaggaagtggggcggtgccatccctaagtccccagtcactttgaatctccatgattctgtaactaaatcatgatacagcaagcaaaccaaaaaaatgccaaggtaaatatcctatcattagtgtgttgtgcacatcagaaaccttaaacttataatattttatagacaacaagtaggaattttaggattaaataactgaaatgacctcagaggttaaaggacaaggtcagctaccaggtacttttttcaaagacaaaaaaaaaaagaaaattctgttcattctaccttagactcaagaaatcattccttacatgatttttttcctgaaatgcaatttcatgatatctcattcaatcctcaacaaataaatatcaaaatcctcctatgtgccaggcatttttgaggcattaagaatagaatttttaaaaaataaagcataaaaaaggggggttctgttcattttagaaggggataataagcaaatcaataaacatgataatttcagatagtgataagtgctaaaaaaagaaaataaagcaggatggtatgatagtaattggttgctttagtatctgctaaaactgaagctactgtacagcagaaatttttgtctattttgctcattatgtcccaagtacctataagagcatttgaatgaattagcaagagataagtaaatggcactctttacattgtggcagggactgctagctaatcactaagtcagtttctaccttttcctgggctcataggtagattatatgtattagcttgccacaatttccattacaaaatacttcacatggggtggcttaaacaacagaaatttattttctcacagttccagatgctagaagtccaggatgaaggtgttcgcaggtttggtgtctcctgcggcctctcttattggcttgcagatgatcactttctctctgtgtcctcatgtggtctattctctgtgtgtacacacatctctggtgtctctctctatgtgtcctaattgtcttttcttataaggacatcagtcagatcggattaaggtccaccctaatggcctctttttagcttaattccctctttaaaggcctatctccaaatacagtcatattctgagagtactggaggttacggcttcaatatatgaatttggccagggttgctggggagggcggggagggtcacaattcagtcctaacactacatttcccagcctcccttgcatttaggtggaaagcagtcataaggctacagccagtggcatctgaatagaagaaatgtgtgccacttcctggccagctccatagaaacctcatggccttccatgctgtttccccatctgctggcaggatattgacccccgtgatgatgttagaagcctcatggtaaaagtgacaaagcctgggtccctgaaaatagtggggcagaacttacaactgtaccattgacagaggcctacatcagaccactatatgagggaaaaaatgaacacgtgctgagatttgcttattacagcagttcgcctacattaaacaacatcacttcaattatgccttcagagctcctagtcttccccaaaagctttctgttattcaagttaaagagttttcaatttttaaaaaagatttcctcacaggactatgatttcattttttaaagtcctctcttcctattctctttactttcagcgtaaaatacaggcaaagttatccaaaaccaggcagaggtcttttagtgtaagttttcactgttaaagattggcacatcacagatgaaagttaaaaataatatattacttatcatgagataatgcaaggacataaaaaccagagattcccaatattcttaaacccatagtttcaacctcacaaaaactaagcctgtatgggccaactcagggttgccagctgctgctgtggttcatatactaaaaataacagggcaccaaggagcagctagtcaggctgaatctgggctgcagtcctccctggaccaggaacaacaaacaaggtgaaggaggtaatagggggttgggggcaccagtcttcgctgcagtgatcccgagagcaatggggaatccaaaaataaacattggttgactccagtgcccttgaacaagtatgcaagtcactgaataacagagccagctaatctaaatgccaatctaaacttctcctgagctgctaatgcaggtggccagatctttaacttctaaataagtttaccagaagaggtatgatgattttatgtcatttatatttctaacagatgcatctgacccattccaaaatatctaaaattttcttttaggggcccagaaatataattcacagcttgagtgatgaaatacaagcagcagcctgcctatttgttccttccttccttcatgtcttcattcattcattcattcaacattattatttatacctaatatgggccaggcactctgctaaggactagggatacatggctagtagaatctagtcttttccctcggggatttcacagtctgagaaggaaagcacatagaaaaatgtgataattgttatataggcattttggcaaggaaggcagagaaggaaatggccagccccccgccaatggagaataaagatgaaaacagaaatactcccaagacccccaaataagtatctattacagagacttcctctacacttggttacaaaagaaagaagctttaatccaaacaggggtctaacaatgtaaaataattgcactgtaggcctaaaaccatgaaggaaaaaatcaagtctcaaaggagaaaggcctgaacatcttgaatgcccagcctgaccttgtctgtgtcctgttctcagaaggtgtctcccaagttttcgaggtaccatttttctctggttacctccagctcccaagagtctcactaaaatacaaaacacatcctttaatatggccctacttcctgggctccttaaacatactttaatacctgttggaacatatcgtataaaagcaattcatcacttatcttctcccaacacgcagcctgtgtcttcaccctggcggactggcattttaaagtcagtggcatctaaacgatctctgaaaactgagctttttaaaacaaaataaaatgggggactaagtcatgaacatcagtggtctaaaccttatgtactttttgttttatttcatattttaactagatttacttacagcaagcatcttttgtagttgagaaaatgtggattgtaagtggagttctttttggttagtgaaatgacaagttctttaaactcctttcaaaagagagaccaggtctcagattgaggatgtcatgtacaatagtcttttccccttgtaactttcctttgatggccaattaaagctacttattcctacaacaaggacatgtattttgtgggaacagaactgaagccagcaccttaatctcatgtaattccactgaatgactttatttcctccccaggctgactcggggctcccaccagtggatggtggtggtggtagtgatgttttgaatacgaccctctgatctactggatttgggctgagaaagatacttgaatgactttgttgaaggtgaagtaaaggggaaccaaatttctgtaatgaaatatttcaagcagatcttcataatatcttgagtcattgggtaactgaacaaaatttactgaaaggggttgtggtagccagactcttaagatagcaccagtgatccccacctcctggttgtcccacccctgcgtcatcccctcctactgagtgtgagctggattcagtgactcaattctaacaaggaaaataaagagaagtgtcagtgtgtgacccagagacaaggtcataaaaagcagcatgtgtccacacacatcactcccttgaggggaggccagctgccatgtcatgacagccctatagagacacccaagtggcaaggaactgagggcttctgtgaatgagcttggaagcatatgttccccagccttcacatgacggtagtccccagcaatatctggattgcaaccctggaagaaaccctacgctacaaccacactgttatgccagctcccagattcctgacccgtagaatctaaaaaataaaaaataaaaaattttattgtttaaagctgtaaatttagggaaaatttgtcacacagcaataattagtacaggggctaaaagtatccactcccaggacatggtgtaaggagtgccaagaatgtgcccagatctacacaattacaaccccacctcattgctctcaggccggaaatgctgcaagtcctgtcttaaatatgtattcaatcactcatagagtatacattgggtgccctctgtgtacagtcagggtacctaatgttacagatagcaagggaatgtgccccttctgaaatcctatgttccctcccctgaagaatcaaccagctttcctgtcaaaagcagtttttaaggccactaaaaactgaagctaaccattgagctgagtccagggcctcctattaaaaggaaaaaaaagggaacttcatggaatgtagtcaccaccccaccctcatagttccccctaaatttaaatagaaacacttcactctaccctcttaaaattaagtattcacacaaagcagacactggagcataaaatatctttttacttcaccaatttgaacaccagagatttgccttaaagggccaggcaacctgaagcttttcaacaaaaacaactcgtggaatactggaggcagatgatatttcatcttaagcatcaggtatattgtctacaccatcagagattctcaaaggattagtactaaatagtgcctattattatattaatgataaaccatttgcatatcactaacaagtttcacccaggtagggctaatccctcagtttattttgtttgtagatcagccaacaggttccttattcactgtaggcaaggcaagaaacacactttttcttcaacctagttggttggaccaaatgtttacatatacacatttatccccaccattataaccatcatgcagcttctaggacaataatactatttcttacataaaaatattaactagaaaggctttcaattagccaaatgtaataacaaacagatatgtacttaaggcttggctactgtgaaatgaagttataagctagtgaaatgaagtcataagctggtcatacaaatacatatttttcaataacaggattttttaaaagattttttaaaataattcatacctttgttgattccacttgtgccatttgcaatttaacatcagaaaataatcattccaaatggttctccctgctatgattcaccacggtgaatgattctgccactcacagcaaatcagagaatggtttggaatggcttattttcctgctccaataaactatgactaggcattcagcagatttttcttttgtttcttattattttgcagagtcgagaaaaatatgaaaaataaaagaaataactgaatggcccactgctttcaaaacgtatttagtcttgctcacttatgtcaaatctattataattcacctccatcctgctgtttttctagtgttttccatatcatggaaccctcaccagtagacgcccattctctttcggaccccaaggcatggcttaccttttcctataaaactctaagtgctcactgccaaaatagatgtgtgtgataaaattaaagtatttcactggcctttggttctggaaataattggcacaaatctcctttgttgcattaattgtatatcattgtttatccagcgagtatctcagcacccacttagccatctgggcctcagcccagaaaactgacttacatgaaataacaatgaggccttttgacagttttcaatacactgctttaataattttttcaattgtatacttttcctgattcaggagtctaaaatcagtaactacaaagaaacagctgctacaattctctttatcctcctactctcatccttaagattccaggaatcatcggtcagaagtattcaacttaccaatgcttaaacctttgggaaaaaagcatctagattccctctcaaccccagacatctagaaaaaaacaataatgaatgatgatagacccagtcagagagaactatcttctcatcatttttcatgctaatgtataaagttactgatattctacaatcctctgtcttctcaaagcatctacacacacacacactatacacacacacgcgcacacacacacacacacacacaagtatgcatacccagaatctcctaagctaggactgccaacaacccactagcaggggcgaagtttggatgccaaaagacattgtattgtcaaagctagagttacatgaggtacactttgcatagaaataatgttataaatgaagatcatataaacttggtttatctatttaatttatatcacttttcatagccgggctctatattcttgactgggtgaagatataaatgaactagtgggctccaaactgtcttggtcaaacaatacattaaaaattatcatgagcatattcatcatgtatgtgtgtgtgtatgtatttacaaattatataggtattctgctgtgatgcaaactcacaaaaaataatactaggataagaaagaaataatatacataggcattctactatacgtctgtaaactccacacctgcacacctcctggggtgtacactttccattttgaagctccagtgatataccatgttctgccctttaacagttatttgtttggtgggtgaaaacaatatatctgccacttttatgcagcattttatacttcataaagcatttcatacacattatctaaaatagtcctcacaaacaccttctcctcattttatagactaggaatttaagtaacgtaagtgcctaagatcacccaaatggactgtggctaaactagatttgaaaccagggcgatactacagatatacgacagattaaatgggtttttatgtgccagtctggaaaccacaccaccacttacaatattacttccaagggaaaatgctttctgagttctaattaactgacttgtaaaggaacttttcgaatataggtcatacattcaggactagatgtattacatattttcaaataaatgtttttttcatacaggataatctgaaacttttattataccactaatgccaaaaagtaaatcatataaacataaaagccctaccaagcagtgctgagatgcccatgttctataagacagtcacccaatgctcagggcagcatttctacctttacttgtataaccaatttcatgtcccgaaattaatgaaccacattcccttataagtgtttaagaatcagtaaaattttatttataattattaagcttgtaagtgttatgctttagctctggaaaattatctttttcttttaaagccaaaaagttgcaaatgcaagaaagaaaatgcctgtaatgaatggtgctttgggtcagaaaggtgactagagaaaccaaagtatttttgttttccctctgccaaaggtgacttagatacttagacttatgctggactcccttgagtcttcttgaaccctgctttcttagattgccagcattgattaagtaatatttttacttttaatatttaacaatgcattttactttataaaaaatttatatcccctttggcccataacctgacttctgtgaacttaatctaagaaaataatataaaattatcaaaacattttagacagaaagtatttcttcataatgttacttacaaattgaaaatttaaaagcaacttgaatgtttaacaataaatgacagaaatactcaatgatatagcatacttctgtttaaaatgatggctacaaaagccatacagaagcatcaaaaaataaatttagatatattaattgataaaagcaggatatagaccatgtgtgcattatacttacaatgacaataatatcataggaaaaaaacagactagcagcaaatgggcctaaatgaatcaatgttttggttaaagatagtagaattttgggtgacttttttttctatattttctaattttctctgaggtgggtatttttataactaaaaagaggtttctacaaacggcatctgatgatttataaggaatttctacaaatcaataagaaaaatataaatatctctaatcaaaactagggaaatatgaacaaacaattcagaaaaggaaatccaaatggtaataaaatgaaaagaggttcaatcttctctagtaatcagaaaaattttaattaaattaaaataataaaatataattccatgtcataatattaacaaaaatttaaaagttttataattttcgatgtaagggtatatgaatattggagctttcatacacagtaagtaagagtaaaaatttgtacaatcactttggagactaacctggtaacatctaataaagcacataagagtcacaacaatgttcattgtgacattattgataatagtaaaaagtttaaaatgacatgcatttctagcaatagggaaatagataaataaatcatgatattttcatatgatgaaatattataaagcaataaaaatgaaagaatttgacctatatggaacatcacagataaatcacaaaagcatactgttgataagggaaagaagatcaggataatataaacagttggtcccatttaaataaagttttaaagcatacaaaacaatgctattttataactacatatgttatagcagtagtgtaaaaatatgcatgggatagctaaacaccaaattcacgataatgacaactttggaaaggaagaaaaacaaatgggattcggggttgtgaatccagaggacctaagttctaatctgtaatgtaaaacacacaccacacacaggcacgcacacttaatccatctgaagcaagattagcaaaggattattaaagacaactgaatgcgtatttgcagatacataggtgtccattatttagtctttttttcttaatatttaacataaaacattgtaaagaaacaatgagcacctaggctgggcatgtgtgctcacacctgtaatcctagcactttgggaggcctaagagggcagatcacttgagaccaggagttcaagaccagtctggccaacatggtgaaatcccatctctactaaaaatacaaaaattagcccggcatggtggtgtgtgcctatagtcccagctacttgggaggctgaggcaggagaatcgcttgaacctgggaggtggaggttgcagtgagccgagattgctccactgcactccagcctgggtgacagagcaatactcaaaaaaaaaaaaaaaaaaaaaaaggaaagaaagaaagaaaaaaaaaagatagaaaaagaaacaatgagcacctaaaacattctttattggaaacaataaaattctcttgcaagggtccagaatcttatctctaaacaaaataaacagagtgctctcaatgaaataaacagtggttagaactgagatagattcatagaggatgatctaggtaagtaaagtcgtttgcagtctctccggtcctgcttctacttgctgtgaggtgtggcatgttagaaatgttgtttctgccttcatatttggctggggaagtggggcagggagacaacccaaaaaagattgcagcgtattatggtggaggggctcaccctcaaaaaactccgacgccgcagtttaaagtgcttcagctacgtgtattgatgtttaattgtgtagcaacatgaatttggtgtcttaacctttccgcctcctggaagatattgagttatccaacccacaaaaccctggagactctcaaggcttcccaaaaccccaaactctccagaaaggagccatgcttggaaggactagtgaatttcatgtctgtgaaaagccatcttcaacagtctggggggctgcttatcacatagaaatgctggtagggggctgggtgcagtggctcatgcctgtaatcccagcactttgggaggccaaggcgggtagatcacctgaggtcaagagttcaagaccagcctggccaacatagtgaaaccccatctctactaaaaatacaaaaaaattagccaggcgtggtggcaggcacctataatcccagctacttgggaggctgaggcaggagaattgcttgaacccaggaggtggaggttgcactgagccaagaccatgccattgcactccagcctgggtgacaagaaaaaagctccatctcaaaaaaaaaaaaaaaaaaaatgctgataaggaagaagagatgattgctttgaaaggggtcacattctaagtctgttcttggaggcaatgattattcttttgttccagcagagggtgcaccctggcagacaagtcagaatcctatggtaattggcatgcaaagagacatcaccagcagactgctctgccctggagaacaggcatgggggtgagcaggttcataaaaccaactccaccttctcaggccaacactaccaccatgtacaactgtaactggcctgcgccatctccaaaaactaaagcagcaggtttattcattgaaacttaaatccacataatagaaaactttgatattgacatatcccatgttttgatctactattcccttgaaaacatcttttgtgaacaaatatcccaaaacagtcaagcccaaccagcctgaaatgtgtgttgtttgaccttttggccatctagtctgcatctggaggtaaatttggaaagtggagcaaatctactgaaagattgaccctcctccttcctgaatatcccggaagctttttggaattcaacttgcaagtcatgcttcattcgaggaacttgattataatagttccggtgtgaagggtgctggacaggacactacgcggacatcaggcatagcgattcacacattcctctacaaagagcttcaggtgtttttagaacaaaatgaaagaaaatgaagctgagtcagttctcaaaactgtcctcctgtcataagattcaccagaattactcacagttatcacagtcattctcagaaatgtcaagtgtaggtgctcttccgggccttcagaatggttcttcctctctcagtctcctccctctatttggaatggcccagaaaaacagtacactgaccaagagccccatctaaaatcaattgtttgcttaaaaatggctaccataatatatagtggttaccaaagtgtgtcttatcaaagatgattattttataagaaagacagatcttttcaataaagggaataactaacagcattagaaaaaaattgaagaaaaggtgtagagtaaattgcaataatcttgaccatggggtaattaatatttttttaaaaagaaaaaacttatttcaatcactaagacgactcaaacatacaagacatctacttgtattcaaaagactaaatgtcacatatatgaaccagccaagactcaccatctgagagttaaacattataaaaagaaaagtcttaagcttaattctcctagtctatgcctgcttcaaattaacataataaagaatcagaatataggaaaaaagtagtaaaagccctgttaaagaaaaacaatgcacatatgcttattgggatgtaaaatacaaataatctatatatgaaataaatatatttccaaatcaaataagctatagatgtgataaaatatttccaaattttatcatatatttaaatccaggtttccacagcaggtcttaggttagtcaaatagagtttactataattcaagtgcccccccaaaaaatactttagcaagagctacttatataaaaaatggtattgcccatgcaagtccaatgaaacaagtttcctgtttgaaatatcaaatttaattaccaaaatctccatttttttcctctgaacactaaaaggtttcatgtaatgaggttcaatttaaagaactctcttcactacatgatttcatctcacttaaaaaccatagcgcttcaggtgtccaaacaaatgctgcaaactaaacctggacacacatactcacagagccttccccaatcccaggagaaatttatacatgaagatccttctgtttagccaggtgaactctgctagaaattcatattaaagagaactttgaagaaggatggtacaggagaacaggtgcagcaaaggcaccatgtattgagcatcttttatgcgcctctcattttaagtgtttcatctcatacaatccttacagccacccctgaggtacacacaattgcccccagtggacaaaagaagaaaggaaagctcagtgtggctgagtgtgctgcccaaggttacacagtggggaggggtgtccagggtctgaactccacgaggggagaactaccttccaattccgaaccctgtgcctagcaagcaccaggggcaggggaggcatttgataaatgtttgttgaattgaatatgactgtaaggcctatctactttggagcatcctggagaatggtgtcagaaagcccaaatgcaatgtgagggataacaaggaggggtagtccacgcagtctagggtgaaccaagtaacttcacccgggctttcctcggatccactgccccctcctcactcactgtcttctcaccattatctctgtccagctctggacatctgtctgggtttgctctctcaaggttgctgccagccttggctggacctaaggctgcttatccttcacctcacttttcaagggagctggtaaccataaaaatactgcccagccatggcttccatcctttagctatttgggattacccaggccctgagacttcccagcttcccactgacaatgttgtttcaaagtcccaggactttgcaggaaatctctgggaatggagctccagaaaaatctgggtggtcaggcttgtgttgctttcatagatgggttttagtgagagagtttgaatctgcctagagtgtacacctcaagtagttattagaaatatctgttagtagtttgtgttctccaacaggggcatatgagggagtcagggaggtttggcagcccctagcatgcacaccactggtaacctggtggatcagttagttttcacactcctttaaagaactatgtgagactgggtaatttataaagaaaaaaggtttaatcaactcacagttctgtgtggctggggaggcctcaggaaacttacaattgtggtggaaggcgaaggggaaacaaggaccttcttcacatggaggcaggagagagaaagagcaatgagaggaactgccaaatacttgtaaaccatcagatcttgtgagaactcactcactatcacaagaacagcatggaggaaaccacccccatgagccaaccacctcccaccaggctcctccctcgacaagtagggattacaatttgagttgagatttaagtggggacacagagccaaaccatatcacctggggaagagttttaagagactaatacatgaagactgtggaaagaggtacctgggcatgcaccttgtggcagagcctgagcaccaaacagcctcaaccacagggtcttgaaaatgacaccccactcctgctgagagcttaaggaagcactctttcaagtgccctctctgctctgcagatcaggctggttttaaaattacaataatcggtaataatatcaaaagctacaaccacaatttgctgattgccaggtaccatgcaatggggctttacctattctaagccccattgatgggggttattatttccccaactttgcagatgagaatatggaatgggaacttaataacctgtccaagcctcagccagtgaaagagccagctgctaacctggatcccatgctccctgcagccagcccacagatcaccctggcaacccagcagatgagcccaagccacacaatagtgcaacttcttcccagatcccaatagaaagttacttgaacttctacttcccctcctgctttccctcgtctgcccacctatgcaggaatgaattcgtgaaaacctggccaggcattccaccttgggaacaacttctatatcccaactttcttaaaatgtcatccaacatggtgaggaaaatgaacttaaattctgaattacattacaaactgactttccttctcattgtggcctggaccagaatcagccaaacttctctgggctcaacttcctcatactcaacacaggtcagatgggcttctcatcttctagtgtgttgacgatggtttatgtcgttgcctcaattttcaggtccctttggccattgggatgaattacacaatgtgaatcagaagtggacaatcaggagaggagaaatccagccatgtctgggcctaggccactcttcagagatgtggcccacaaacactaacaaaaagtggcatcaaagctctgccagtttccaaatacttttaaaatcctagaaacataccttaggataagaaccttagaataacttctagtccaaacccttgtttgacagtaagtaaaccaaaatttagagaactatctgttcatttcccatcacccccactctcgtagctagcatgtggcaggacttggattccgactgaagactcttttaattcaaaggtcatgcatgaggtaccacaaatgcaacctcctctgattttattactttagccactaatatatttatatttggtaatattgccctgaataggagaaaacagggagtaaagcaacccaatccttatagaatgtcagatacagtaaggctcctgaaagtcattattaataaagaaattgaggcacagaagtatgaaaatgctttgccagtaaaatcaagccagatgatgatgacgcagtggctcaaactccagtctgtagacttccagcccagggctctttcctgacaccctgaggaaacattgcagagatgtcaccagttggtcttgttttctaaagttgttaatttccataacacttcttatttcttagacagttaaactatgtacaactatgaaaatatctgtactcagaggtggtataattacatggaaaaaaatataaggaccactgggacaaaatcaaaagagacaattagaacctgagttaaattcaaaaaacaaaaaaggagaggggcaaaatggctgaataggaacaactccagtctgcagctcccagcgagatcaatgcagaaggcaggtgatttctacatttccaactgtggtacccagctcatctcattgggactcgttggacagtgggtgcagcccacggagggtgagcagaagcaggatggggcgtcacctcacccaggaaatgcaaggggtcggggaactcccttctctagccgacagaagccatgagggaccctgccatgagggacagtgtactctggcccagatactatgcttttccaactgtcttcacaacccgcagaccaggagattccctcaggtgcctaggccaccagggctctgagtttcaagcacaaaactgggcagccatttgggcagacactgagctagctgcaggagttttttttcataccccagtggcacctggaacctccgagacagaactgttcactcccctggaaaaggggctgaagccagggagccaagtggtctggctcagcagatcccacccccagaaagcccagcaaactaagatccactggcttgaaattctcactgccagcacagcagtctgaagtccacctgggacatttgagcttggtggggggaggggcatccaccattactgaggctggagtaggaagtattcccctcacagtgtaaacaaagccaccaggaacttccaactaggcactgcccaccgcagctcagcaaagccactgtagccagactgcctctctagattcctcatctctgggcagaacatctctgaaataaaagcagcagccccagtcaggggtttatagttcaactaagcttcataagcaaaggagaaataaaatcctttacagacaagcaaatgctgacagattttgtcaccaccgggttcttgccttacaagagcgcctgaagaaagcactaaacatggaaaggtaaaactggtaccagccactgaaaaacataccaaattgtaaagaccattgacactatgaagaaactgcatcaactaacgggcaaaataaccagctagcatcataatgacaggatcaaattcacacatataaatattaaccttaaatataaacaggctaaatgccccaattaaaagacacagactggcaaattgggtaaagagtcaagacccatcggtgtgctgtgttcaggagacccatctcatgttcaaagatacacataggctcaaaataaagggatggaggaatatttaccaagcaaatggaaagaaaaaaaaaaagcaagggtggcaatccttgtctctgatgaaacagactttaaaccaacaaagatcaaagaagacaaagaagggcattacataatggtaaagagatcaatgcaacaagaagagctaatatatgcacccaatacaagagcacccagattcataaaccaagctcttagagacctacaaagagacttagactcccagataataatagtgggagactttaacaccccactgtcaatattagacagatctacaagacagaaaattaacaaggatattcaggacttgaaatcagctctggaccaagcagacctaatagacatctacagaactctctacaccaaatcaacggaatgtacattcttctcagcaccatatcacacttattctaaaattgaccatgtaattggaagtgaaacactcatcagcaaatgcaaaagaatggaaatcataacaaacagtctctcagaccacagtgcaatcaaattagaactcaggattaagaaactcgctcaaacctgacaatgcatagaaactgaacaacctgctcctgaaggacaactgggtaaataacacaattaaggcagaaataaataagttctttgaaacttatttcaaagaactttgagaacaaagacacaacataccagaatctctgggacacagctaaagcagtgtttagagagaaatttatagcgctaaatgcccacaggagaaagcaggaaagatctaaaatcaaaaacctaaatcacaattaaaagaactagagaagcaagagcaaacaaattcaaaaactaacagaagaaataactaagatcagaatagaattgaaggatagagacttgaagaacccttcaaaaaatcaatgaatccaggagttggttttttgaaaagattaacaaaatagatagatcgctagccagactaataaagcagaaaagagagaagaatcaaatagacacaataaaaaattataaaggggatattatcatcactgatcccacagaaatacaaactcccatcagagaataatataaacacctctatgcaaataaattagaaaatctagaagaaatggatgaattcctggacacgtacaccctccaaagactaaaccagggagaagtcaaatccctgaataggccaataacaagttctgaaattgaggcagtaattaatagcctaccaatcaaaaaaagcccaggaccagacggattcacagctgaattctaccagaggtacaaagaggagctcataccattccttctgaaactattccaaacaatggaaaaagagggactcctccctaactcattttacgaggccagcatcatcctaataccaaaacctgaaaaagacacattaaaaaaagaaaatttcaggccaatatccctgatgaacatcaatgtgaaaatcctcagtaaaatactggcaaactgaatccagcagtacattaaaaagcttatccaccacgatcaagtcggcttcttccctgggatgcaagtctgattcaacatatgcaaatctataaacataatccatcacataaacataaccaatgacaaaaaccacatgattatctcaacagatgcataaaaggcctttgataaaattcaacacccctcatgataaaaactctcaataaactaggtattgatggaacgtatctaaaaataataagagctacttatgacaaacccacagtctacatcatactgagtgggcaaaagctggaaacattccctttgaaaaccagcacaagacaaggatgccctctctcaccactcctattcaacatagtattggaagttctggccagggcaatcaggcaagagaaagaaatcaagggtattcaaataggaaaaaaaaggaagtcaaatggtctctgtttgcagatgacagaattgtatatttagaaaaccccttcatctcagcccaaaatctccttaagctgataggcaacttcagcaaagtctcaggatacaaaatcaatgtgcaaaaatcacaaacattcctatataccaataatagacaaacagaaagctaaatcatgagtgaactcccattcacaactgctacaaagagaataaaatacctaggaatacaatttacaagggatgtgaaggacctcttcaaggagaactaaaaaccattgctcaaggaaataagagatgacacaaacaaatggaaaaacattccatgctcatgaataggaagaattactatcatgaaaatggccatactgcccaaagtaatttatagattcaatgctatccccatcaagctaccattgactttcttcacagaataagaaaaaactactttaaatttcatgtggaacagaaatagagcccgtacagccaagacaatcctaagcaaaaagaacaaagctggaggcatcacgctacctgacttcaaactatactacaaggctacagtaaccaaaacagcatggtactggtaccaaaacagatatatagaccaatggaacagaacagaggcctcagaaataataccacacatctacaaccatctgatctttgacaaacctgataaaaacaagcaataaggaaaggattccctatttaataaatggtgttgggaaaactggctagccgtgcagaaaactgaaactggacccctttcttacaccttatacaaaattaactaaagatggattaaaaacttaaacgtgagacctaaaaccatacaaaactctagaagaaaacctaggcaataccattcaggacataggcatggtcaaagacttcatgactaaaacatcaaaagtaatggcaacaaaagccaaaattgataaataggatctaattaaactaaagagtttctgcacagcaaaagaaactttcatcagagtgaacaggcaacctacagaatgtgagaacatttttgcaatctatccatctgacaaagggctaatatccagaatctataaggaacccaaacaaatttacaagaaactatcaaacaaccccatcaaaaagtggatgaatgatatgaacagacatttctcaaaagaagacatttatgcagccaacaaacatatgaaaaaaagcttatcatcactggtcattagagaaatgcaaaccaaaaccacaatgagataccatctcataccagttagaatggcaatcattaaaaagtcaggaaacaacagatgctggagaggatgtggagaaataggaacacttttacactgttggtgggactgtaaattagttcaaccattgtgaaacacagtgtggcgattcctcaaggatctagaaccagaaataccatttgacccagcaatcccattgctgggtatatacccaaaggattatacattattctgctataaagacacatgcacacatatgtttattgcagcactattcataatagcaaagacttggaaccaacccaaatgcccatcaatgatagactggttaaagaaaatgtggcacatgtacaccagggaatactatgcagccattaaaaaggatgcagggacatggatgaagctggaaatcatcattctcagcaaaataacacaggaacagaaaaccaaatatcgcatatattctcactcataagtgggagttgaacaatgagaacacatggacacagggagggcaacatcacacaccggggcctgttgggggttgggggactaggggagggatagcattgggagaaatacctaatgtagatgacaggttgatgggtgcagcaaaccaccatggcacgtgtatacctttgtaacaaacctgcacgttctgcacatgtatcccagaacttaaagtataagaaaaaaaaaatgctatcacatacacagccattttcagctgggcaatcaaaactgggccatgttgaagctttcaccccacaagctgaaatacagctgaaagatccacgccccaggggcagcctagccaggctggacaccagctcctgctcccaggcttctccccctcaccctctgctttcacagacctcttccacatcagaggctacacaggaggagggagccggttttgttttctgcataataaagatttcaaaaggcgaacgaatgaaacttccatgccttgttcggaagaagttcattttttaatatatttaagaaacatctaagcatacaaacaaaaaattttgtaaatgtacacaaagcccccttgtggaagtatatttaaaaaccattttgagggctggaatcttggaaagggagaaattatggcattcatgatattgtaggctcccgtgggctggtcatcatgtgaggaatagatgcaggtatctgacggcagccgaagcagcataccgtcagccagactgcctgcctcctggactatctttgtataactacagaatccttttttcttttccttgtagccaccaaaaagaagtcccaatatagaccttagcggatttcatcccattttaattctacattgcttttatctatcttttatcagaggaaggaaatcaagcggcataatttggtttaccttttttttaactttcaagaagaaaatatcttcatatctcccaaggcaacagaatcttttgaactaataaaaaccatacaatttcctaggtaccagtttttcctatggaagatttttaaatttccttctaggaaaaataaacaattaaaacacatcctatgaagatatgttaaagaccacgttgagttggaaatgaaataaaatgctgcatgttctgcatttttttaactcaagaaaaacttttttgactttcatgatgtgcatatggccattaatttcaatgtgatattatggtttttggctgaacagacagtatgtatgtatgtatgtaagcaaacaaaacaaatgcattttgtattcaaatttatacaactccatacatttttatgctgtttatttgaaaattaattttggcttaggcctcagagacagcaaatgttgtcaagatttgagggctacctgaaaagccttggggacagcattacccttatgcataagaaacagcaaaataaaataaaaataaatgaatttccaaatacgtcatggctaatcccttgagctgacctacagatgaattatggaggttttgctacaggactgagatctggtgatttcaccgagagatttatcttattttccaacttattttcatatcttatttccttttcttttagaattagactgtaaataaaagagctaagagtgaaggaagctccctttcacagaactcatattggattgataaattaaaatggtgagatgagttttgtatgacccatcctcaaggatttgggaaatttagccgatgcaaaacaaggcattaatttggagaggcctagctacttacaatgcttagtattctgacaatgatgaatggcatcattccaagcaaatggtaatttcactttttgtgacggtactttagagcaaaaccgactttcttcacacaaagaatttgcaatcctattgaacagaggcagtacctgaatatcagaaatccttcattgtttaagtatcatctgatattcttgattggcttcagactgaaggttggagttgaattagggagaacggaggttaagtcctaaccttgaaagacttagcagccattgaaacactgcctttgggcacttattggcctgtatttataaaaaaaaaaaaaacttttcaattcaatgaggggagggagaaaacacaaaacttgtcacattcatcaagtgaagccactggaaagacatctacagaacacccaaaaagcataatctttccgaagcgctgatagaaatggtaattggatgggtcagggaataatacaaccgaagcaggggcaaagcagaatatcgctaaaaaatcaaggtcaaaaagaaaagaacagacccttcttaactagtaaaaaacttacacttggcctttgtactaagggaaaaatatacctgttgctacccgtaatttatgtcctcacaaaaacctctcgaatagaaccttcaaacataaaaagcattaaagaccctcagtttcacagcccataagaaagcttcgccttaaatattggctccatcaaaataagttttctgcatgcagaaaagaaaatgatttttaaaaggagcaactaaaagcagtgactccctttctcaatctaagccatctgtctttccagcaggggaaggtgtgccctgcgggggtagaaatacatttaacaaactctaccctgggggactgaaaaagaccaggcactccgaagactggcagagaatgccagcactgtctccccagagaggaacagacctgatgaatcaccaaatctgggttgctcgttttcctgccttctttgctaatgagctaatcagggctgagccaaatgacacatgtaaacagatgagccgtccggggatgccgccttgtcctgcttttatcttacacaaacacctccacactggacttagaaggcttttggcacaaggcagagaactgatattctgggctgcatccagctgggaaaggaagagaactagtgaagtggtgtgtcgttcaactggtggaactgcacggatgcaggtgtctccttactgacaaagatatcagttaaggggggaaacagtccctgaaaagacagtatctggagcccctcctcttcatccaaggaaataaagcagaacaccctcaaaacctctctggacaggttcccttaagagttaaaaaaaaaacaaaacaaaaaacccaaagctcagcctagcatttccctgtaaaccgtacaaattcactgatacacaagaaagacagcatcatttgttaattcgcaaaattctaaggtgcctgtatacccatttctattaatctaggaattcaactttccacattagatttctacagtgatgcagggtaggagatggagtttatgatttgtgctgacagagccacatcatattttagggagatgacattgctattgatggttccttctaatctattcccagtaacatgctcatctgtatgttttccccaggcaccagaagaacaatctcagatccttaaaacagtatgtcattcctttccacacatctcatatgcacatatattattattatttaacgtttattaagtaccaacagtatgctaggcacaatagacatagggggccataaaaacatatttaacgcatcaaaaaccacaataaaaggatgctgtgtatgtgacagaagacgataaaaatctctgcaattcatagttcaagatgaaatgcaccccaagtcccagagaagccttggaacagtgtggcacatcaaaaaaggtattggaatttttattcagccagcgtaaggaaggttatgcataccttacaattaaacatggccttcctcaaccttcccaacattctgcaacaatgaattctctaatggtaagccactaattacttaatttatctagttaaacttcagcactctacctcattctcaatcataatagcatatactctgtaccaagcactatggtagtcatttaaaatgtatttctctgtatgagagtggggttgaaacttggaaaggttcagtgatgcatccaaggtccatgatcaggatttcattttattgtctgttttccaggatttcacttcctgttttacacacacacacacacacacacacacacacacacacacacacagagagagagagagagagttaagagtgataaatgccattcacaagtttggggatttggagttaatataatatcaaataaccaatttagacattgtgtagacatagcactggccgggccaagatagatatatgctaggggtctcaacttcttcacttgctaacgctactttagacatggtttagtgtagggtaaagagcatggaaccaagttttctgagtctgaatcctggttttgccacttctaagctgagtgactataagcaagtgaattgacatctctgtacctctgtttcctcacatgttaaaaagatatgaggaaaataatagtaacttatttcacagagttattgtgaggatgaaatgagttaacgtataaagaaaacttagtacagtgcccagcacatagtaagtgcttaaaaagctgttatgtcatcagagtcctggcattgagaagcagataatatgttttgagtaaaagacattgttgctgatgcttatcagtaaaccctgtgctgcaagctgctttataattaataaaaatgagtttacactagccatctaactctcttcattccaaactttcatgaacctaagtgaatctacaagacagctggctaaaaccccgaaaagttgcctttttttttttttctccaaaactgctgtaaacactaaaaagttggcttttctatggtcgcctttactgaacaccagatggatggttagaaggtaaagaaaagaccagactcatagtgttaggccccatggaggtgttaaatgaatgaatgaatgaatgatccgacagtgcctagaagctcaaataattcaacaaggcttcaaatttggattcagaatcttctttgaaattgggcaactctcagccacagccagactaatttgcatattttccatgtattttccacttcctccctatttcattgtacatcttctggaaatttctctacttgttatttctacagaggacctggaggagatgggagaggtaaacttcaagtcagttaacggagctcattgttctctaaccaagtgatagccttagttggagaaaaagtcaaagctaatcactaaattcagatttttggattatcagtcaacatgaattgaccatgcattccttagacaaattaggattagtaagcaaagtaggaaaacaatcagagttgatgcttcgtactaagaaaaaaaaaagacgttgttttctaatatggtacttattgtcataaatatcaagggattagataactaactgctataaattaagggtagtctaaattataagccctgttcattaacaagtataaaataattgctttagacaacttaaaagatgtgtgatatggacttgaaatcacaaaatggaagtttttaaaattattctgtggtcactatttcctttaagctcagttactcagtgggaattaaaaacctgccaggacttcttcagtgatacaactcacgatgcttttttaagggaaattactatggagcataaatttttttttagagtttcacacctttccaaaccacttttttcctgaaggatattgcctactttctgtagctctaagcttaaatgtggtgccatttaattacatacagactaataaagcaagacatatttaaatgtaattttgtagcttgtacacataaactcaagccagtggatgatgaaatgctgctaaaattatccttatccagtaaaatttattgcagtgatgaaaatcttgacatctattccaaagttcaaattaaactttagcgtaatagagtagcctaagttaaaccaaagtaaataagcaattatttatagtaattgcatgtgtgtgtgtgtgttgcatgtatttaacttttcagaagaagtcagtgaacccacattgtggggaccgctgaattaattacaagcgtacacaaaagggtatactcttcaatgatctcagcatgtcactttgaatttatccatctgcctaatacccacctgtctagttgctctttcatttaaccacatattatggcatcaatattaactttcagatttgggtaagaccattgccatttcccaagctatttgcctcctaataaacacagactgaaggggaagtgttgaaagctagggcaatatttttcccataatgtttgatacaaatcccagctgcacaacattgtatgttaataaccattatttaattaacagatgaagaagcccttttgagctgctctggcagattttgaacttgatcttctatcatttgatgtcatgcaagaccagataaatgacaagtctttcgagagtctgcagagcccctttagaacagctgcacagtcttcccccttctttgcagcaggtttctcacttaagaaaaaaacacgcttcattacatcgcctcttacttgagctgcaagggtctattcaaggaagataagcctcttagaaatgaagtagcgttgaatttaggttttgagtgacagcaggaagatttatccattcaacagacaataccgctttctctgcattaatctaggaggcggacaatgatctgttttttaggcctcatctcatctctttcccacagcagaaggtgattagagttaggaaacagggactgtgaaagaaaacttgagcgctatctctctagccctcctgtttcctgaaggggtaagagggagcccctaggccaagggcatcaatcacagattcacaacaaggatatgatgctttaccactgggaaactgataggccacaggtataaaggggtgagccccagaacccaaagggtaaggcattatagttaacctcccaaaaagggaagaaagcacaaagtagctcttcataagtgaaagcccttgaattcttcctagctgggcccaaatgaaaatgtcaggattctcttggactgaacatgatattctaccacctatacacgggttaaggttcagtgaaatcccaactagctgatctgccaacagcagcctaaagagagagcaggagacacaaaagaatgccatgcaacatttgagtgagatttccacagcacaaccatttcatctcatttatatccatcttctgcacctcaggagaggattttcgtaggagcccaattattaatttgaagtatccctctcagccaagcactgagcacagagcccattgtgagcaactcgtcacctgctaggaatctgcaaagatattaccctgaagtccagcatgagaattccattttacaggaaatagctggtactatccttagtgtgggaggcttgccactttattagtagactatttgtctatattttgaagtgcagaaattgacgaatggactttagagagaatatggtggcgtcgaacaatgctttcagtttggggcatgcaatttttttaatttcaataggttttgggggaacagatgacgtttggttacatgaatacgttctttagtgatgatttctgagattttggtggacccatcacccgagcagggtacgctgtacccaatgtgtagtgtttgggtactgctactgccacatcacaatatccaggatgccttttatagactactcacagtcttgatcctttttcctttagctcactgtggaggtacatatcaaatatctaaaactaaatgaataaaataaaatattcacctccagttaccctcaaagtatccctgcaccaagacaatcaaaattgggcccaaaaaggtttagaactcagatactggaaaacaagtatgaggcaacatgcttttgtgtgatatctattttcctgaaaaggcagctcatggaggctgggagagactctcattcaagtgtgagtaattaattaagttagtaagtaagcagagagaaaagtcatagacattaccacagaattaaatcaagttgccccaaatgacttgtaaatttaagagcagattgtgtgttctctagaaatcaatatagagtcatcacattttgagatttcctgttgttaaattgtgttttgttttgttttgtttttgcaaaatgtcgtattgacaactagaggcttccttgacatttaccccacgtgatactggaaatatctgttcatcaatcttaaagccactgtaaccagccaaatattgtggtgacaggatgtaatccatgtttcaagtctcctaggaacccaaatccaacaccaacaccaacaccagaatgtggcttgaagaagattctgaaggaaaataagaaaccatcactcagacctctttggaaatcccttatagcatcataacacagaggctatgctcacatagtgaacaggtcttcagaaaagcagtaatgattcaaaacaaaatgaaacaagaaaaggagcaccgaatctctgatattccatattgtccaaatgagtcctgggaaagatggttttcttcttatctctgatcttcagattccttaatgtccatctttatagcactattatcgataagttcttctttacctactgcttccataatcaaaagttgacctcccaggtggcaaaaaaaagcagttcctccaccatcaaaccctacctaatgggcctaatcagctcctaccatgatagtctttattttcttctttcttgctttctgcctttttttttcttttttaattactgaagactcttgttttggagaaacccctaattgcttcattttgagatgttatgtttaacctcaggaaatggtgctataagacctggcaaacagctttctggttgtttcaatcagtaccagattatgaggtccagccgggtaagaactctattcattttcttgccctgtcatcttgatcttatttgaatgtctggggagctggaggtgcttagctggccctggatttcaggactgggggtgggagtaccagggagagctatgcgatgtgttagagacactgaaagttttcattttgactccttaatgagagcgacctttgacacaggctgatgagttccatgcctgtcctggtgtgctttttgaaaacatttgacactggtcacaggtctgacagggatatgactaatgaagtcgtggtataaaaataatgggctgcaattgcaagtcatttgcatgaaaccaaactccttaaaaacttgtctctgttcactttctgttttctaaatgagtcaataatatgaatcagatgggttgaagggaatagactcccaaatattccttctataagtttggtaaattagttggcatttggtgcaatttttgttgccttgaggcctggtttaaattggactgtagttactaaattgctagggcgattgcagaatgtgtaggataatgcataataccttgtttttcttaagcgtttcgtcagagagcttcttgtgaggtcaaggggcccaggcagcgctttgcagaaaatatcaagcgagagtagatgaagaagaaatataaggaggttgtgggggagggagaaaggaaaggactaaataaaagaaaggaaaaaaagagaataaatgtagaaagaagaaataaaacaaataaaaaagagggcaacatggattggggtccaaaaacacaaaaggacaggaacaggaggaaaaagagggagatggggaaaaacgggaaaatgaacgcagagtggttaaagaaaatggggaatagaagaaaatttttaaagggagaaccctaaaagaagaagctaccatgttgacttcagtttatcctgtcaaactgtgtattatttatcctcacacaggttaagtatccactaaacaaaactctgggctaatagcagctcacagctcacacactagggccaatccttcccttcctttgtctctgcacaaccctgccaaagttcctgatgtttcatcctttcacctgtagctaaaaacaccttcagagaaggttttagcaaaacttctgaaattacatttgaccagctgcgtcaggaagcagcagccaggaggaggcacattgtacaagttccttcctagagccttcctcctgtgggactgactattcatgatttaaacacttagggttttctttatgatttgtcagtttcagcacatctatttggaactttgttttgcttactggtatatacgacaaaacgaaatatcatgtgttcccaaacttaaataaaaagaaatacaaatgatttacagatatacacacatagaacaaatgaataaaggaaaggttacatggcacagaggaaattgtacaagaggtttggaaatgaaccagctccagttgctctgtgaccttgggaaattgtcttaatctcactgagcctcagtttcttcaatcacaaaatgaaggattaaaagattgttttacaaagtactagcaaagtacctggcacaccatgagtagctaaaatgaatgaatgagcaggcagagtagtaatactctcttttgtgcctgcctttcaaggaagtatttctcacctaccattcatacataaagaaatcaataataattctacttatatccctcgataacactgaaaatccaggataaaacatgcatagactccataaactaaccgcattgcatctgttggggttgtacattctactcccaaaaacctgaaatccaaacaactaacaaagtgaaacatgttgtcctctctctccccctctatctctcgctttccctccctctctctttctcttcctgtagaactgcccatcacattccaaatctccacttaaatgcttggattagtgcatgccaacccaaactcctatatttactacttctaaaaaagcacaaactaaggattaatgttcataatcatgacttgataatagttgaagattggtaattttttgtttgtttgtttgttttttgagacagagtctcactgtgtcacccagattggatgcaaacagaactcactacagcctctacctcctggatccaagcatgccaccacgtctggctaatttttttttttttttttttaagaaacgaagtctcactatgttgctcaggctggtcttgaactcccgggtttaagcaattctcctgccttggcttcccaaagtgctgagattataggcataagccaccgtgtccagccagtaaatattttaaaatcaattatttgagaaatatttaccgtagcttaattctcaaaaattgatcaattgtggttactttcagtttgtcacaactggccaaatcctggccactgcaagccccaattattctaaatatgcatgcatttactctatgaattcctgctgagagaatattatttcagttatttgtcttaatgaggctcctcagtccataagcaagttttgttattgttactgaaataaagacatagaagatattctcattctaggaaccaaagctaacattaaaagacagtaatagacattagaacaaatttttttaaattaaagagttgtttttttaagaaacaaaatgaagtttaataaagacagaagaaaggccgggcgcgggggctcactcctgtaatcccagcactttgggaggccggggcgggcggatcacgaggtctggagatagagaccatcttggctaacacggtgaaaccccgtctctactaaaaatacaaaaaattagccgggcgtggtggcgagcgcctgtagtcccagctactcaggaggctgaggcaggagaatggcgtgaacccaagaggtggagcttgcagtgagcagagatggcgccgctgcactccagcctgggcgaaagagcgaaactccacctcaaaaaaaaaaaaaaaaaaattacagaagaaaatgaagaatgagttagagaaagtctgggaaggctcaaaaggaggacacttagacttgtagtacatttccaattgaatttgagtatactactggtaaactactgtgtatttctaaagaaagtgggacttaacaagtgagtatgacatttggcagctgagaaatcatcctttctctgtaatcaataatgctaaagactatatataaagtggtccacgctgcccagcactgtattcacattttaaagaatgaagacactgaaaatgagcagtaccaaaaagtactaagaggatgaaaactagatcctaaaaggaaaagacaatataaattctagttatttcactagaagtgttcaagaatcaagtgcgaaaggatcttacgagaatgatgctgactagttgtctttcatttccacagattatcaagcaagatgaaatgggaaaatggatagaacataaagaaaatcttcttgacagtaataaatataagaacatttttaaatattggacaagatgaccaatagaggttatggattagaggtcttagaaatctttttaaaataggagcaatgaccatctgtcttaaatggtttgtgtctttacctgcctggaggccaaacactgaatcattaccaaatgtatggttctattatcccagagattgatgtcattacctctgaagtttaatgcaggggaatgggacaggcaattgaatagtgctgaatcgaagatttaaggattgaagagatgatgatacaatataagtgtagcatttaatttctctaaaactccagagaaaataattctataaaaataaaagtttgtggaagttctattttgtattttaattatgtgtgtatttggctcatttcctttattaaaccataagcttcttgaaggcaagagatgtatatttctcctcatttcgcctctacctcaccaacccacccaaagtccctaacaccagggccaagaaccaggtattattaccaggtctatagacacctataaggttatacctgtccatgccctgtcagactggtttgctgcctggaccgcagaggttgttaactattttaaatattcctacccatcccttcttaaaagctgcatcttcatgagggtagggagttttatctgctttgttcactaatagcacctgtaacagtttctggtatatagtcaacacttaataaatactggttgaatgagtgaatgaataaatgaatgattgccattcaatacacttcttgagggctatttaggaataacaagttttttaaatctcccaaacagaaaaaaatgttaagaacattcttagcaggtggttctgtatcctgggaggcaaatccatattaattctaacatttttgtcttccttctccctatcatattcctatgcaagactctacaaccacaaaattgcaccctgtatttcaaaacagagaaaacatttaagatcaacagtcttatgcagaataattaactcaatttctattttttatattttcatttcaaaacttcaaatagttgtctaatcaataagtggttttaaatctacattttcctatccatttctttgcaagtaaagtaggaatgagaatacttgctcccataggggaaacacataaaaaccatagaaggttatgaatatactatttagtttaaatttttttacattataaaccacactctgcattcaaatttccatctttacttttcccatacctttatattttaagcatctaaagccaacaactgtaatagtttgctgtctagttagcataatttctttattgccttgggcatagatttgcaatgtaatataaataacaatactattttgcatggctattgtacctctggaaaccctttaccaacattaattttcacaaccgtccttaaggaataggtgatcactgatattaaggctcaggctaatgaaatttggcttaaagaataatatattcgcaaaaaagttttaatttaccatttgtcagtttagtgttatatgggtatgtatttgtgtttcactagatcccaaagaaagcatttgcctttgtaacatcccctaggaatatataatttcaatttagattcttcacttacccagacaggagactgaattctgtttgtttgttttaatagatctctatgtctaccttacaccaaagctcagtctgaccagatacacaagtgaaattattcagtttggtcagttcttaaagcataaccatctggtaatgttctctgcgcagcagcttttagaaatagctttccacttactaggtatcagcagttagtgctggcatatctgtagtaatcgtagaagaagtaatcatagtactggtaatattaagtcacatttattgaggactatgtgccagttcctgttctaagcaccttacatgtactaactcatttaactttcataataacctaataacagcagtgcagttattatccccacctttccagatgcgggaacttggacaacaaaaagaggttaaataattgcccaaagatgtatacctaataaaaggtggggtcagcattccaaccaatatttattgagcatctaatttttttgccagacacttcacaatgctttcactgcccaatatttcctgtaatacagaaatgatcatactgtattttgattcagcaacatttatcaaaaagcctggagctgtcaccaaatatttctgataatcacatctctttcctaaaacaatgagttttaagagaacagtaacattttttgccattggcacatatggcatggtttctgtcaaagggactgtggctctttatcacatgtaaacccacacgccaacacacacacacacacacacacacacacacacacacacacacacacataaacaatcacctgttgaatgggccaactcaaacaactggtcagtgaaagctggggaaatcagtcaaaccagttatttgacaccttgtagaaaaaaaagggaggggagatgcaaatattgttggatctaattttttacgttttaatatcctgtaccggaaccatgcaaagtaatgctagaacctataaaatatttaggaggaacctggtaaggacaaaagatagtttccaatgctactctaaaggtgtattgatttaactgcaaacagttacattgtacactgtcatagcctaatgcttcatggaacaaagagtttccagttgcgtctccatgtcttttatcttttaaaatgcacttttctatttgtttacaaagttctattattcacctgccaggaaaaaaaaaataccaaatttaaatgaatccctttatccaaaattaaatcctggccttaaggatcagatccagaattagccagaaatatgcataaactccatacagttccaaattaatttgttaatttaattaccataataattaaaattgtttaccatattgtcatcagaaaccagaagaaaattataagtaaacagaatctttattatttgtattaagcaaaataaaattacataaagagagacctggatatgtagagtatctttcatcttcaaagtagtttctatatcttctgtataatattacagtattcaatgtaagcactcattttatcaaacaacagagtaaataacaaaataagaacataaagtgacttgctggctatagatgatgacttccccaaggctgccgtgacttatatacctttctttggcaactccttttggaattcttttttattttgccatagagatttttgtgggtgacttttattttgttttgttttgatactttcatgagctacaatattatgtggttctccccttctacaattcgtcccattaaaagttctgtcatcctgttagacatataagtgacatggtggccagaattcaggggtgaagggaactgaattttgaaaccacacaatttatgtggaaataaagtacattcctcatttgtttctgcgtcagacatatgggaagactgtgtataataggttgtttcatttgtgtgatggagagatttttttttaagccttctgaagaaaaaagtcatactgatgtctacgttcatctatgcttcttttcccgtgttttaatgtggaaacattttagaactcacagtttccacacttcgtacgttttccacagttaattaatcctgctttccctcatgacaaatgaccctatctcataaaaggacacattggcaagcaaggatttaactcaaagaagctgttctttgatatatatgtatgaattgggtttttttttaatttaaaagcactggactctcagaatatgaaaatgtactacatctcctacggaaaagtaaatttggaaatcttttaggtaaatgaaatacatagggtttttttcttgtcttcaagaaccaccatgtccaattagagggctgggaagtatgactattccatatctatatttttaagtctaccataccttgtgctctcaactcagaaaattcagaaagtaaaccctactcaaatggctgtgtggtagcttctgaaaattcccaatgcaaatggccctcttttttccctcccaactctccaagtcttagggaaagaaataaactccgaattattaacctgttgctaattttccctattactcaatattaaatgaagatggagaagaaggccccaggatattaacctaggctgtccgcttcccacagagacacaaggctttgcagcataagagctagaagggtgaatgacaccactattcttatctctaagaagtaactgaaaatttcatagattgacaataggccaaattcggccatcccatatccctacgcctctctagagaccaggaaggcaccatgttagagtagattctactttaaactttataggtaactgcaggtcctaggaagtccatgccacctctcagggcctctgtttcctcatttgtaaaatgatgtggatggaaaaaacattctctaatgacccctcagctctggcattttatgattttctcttatgccatgtaatatggcatgctattccccactgtctcccctccccaacccccactgatttattgctgaacagctagtccatacagcaagctctgggcttaacctggcctcacttgcattagtagaagcaagttatttctcatcttcatcgccacactgcaattccgactcacatagaaaaatctatctatctgcctacaaacctatacatccatctacctacttttaacaaatctgtgttcaaatcacatgcaatttctgaagaaaaattagtgtttctaaggctgattcccttggaatcactgcaacaattttgtcacaaaagacaccaattgagccaacttgcaagaccctttaaaattcaggcattctgtcttcactttcccttttattcagcactaccctttcttggcatctttggactcagaactatgaatctccacatgccttccattttgttccacatctggacaagaggcaggaaaacaacagatcatcaacaagttcaggtggagtttgtttttgttttggatttctataaacaagaagggaaaacaaactctaagtaagcattagtttttaccaatttatttttctaacatgctacatctctgggggaaaatatctactgatttgatgaataagtatgaagttgggaagcctgctcttataggcatgaggtaaataccaagatgaataagatgactaaggaagctaaaataggtataatagcaacaatagcaacagcaagagatattttgggttatttgctctaccttagaatcagagtgcccacaccgatacatgagcatacctggcaaaatctgctcccacagaggaatggccagtgcagaatgttcttctctaaatggttgtcagaggccaatttgttaagactagaaatggagaaccagaataagaataaaatccttttctcgaaaattcaggcctgtcacataggtacaaaggaggatgtatttttaaaatctctgttgtatgtcaggcaccatgctaggtacttctatatgcatatttcatttaaccttctcaacaaatcaacagtgtgattctcactttttccccattacataatgaaaaccttgggatttttaaagtccacgcactgccacttgatggtggatgtgaaataattgtacattaagattattaagctgctgcagctagataaaatatttaacaagtattaaactggaagtgatcatgtgaaatcagttttagctaagatactaatctagaagttactatctgtactaaagacagcaaaatagaaagcgtccctaccagcacagcataatgcaaaacgcaagcaaggacaactagtagcaggccttctgcagaacctattagagaaagcaatctgctttagaattgatggagattccctaatcaaagtgaaattgagcaaattcctaagccagatggggagttttctgctagcaagtcatcagaaacaaggatgccaacttgatcctatggaaaggcacagtacaagaatgacatggaacactacctcatcgagaatagaaaactccagaccctaccaggactgtggcaatcctctcagccctctcgcttattagtggaggagaactgggaatcaataacagaatccttttgtacatcatttatatctttgtacatgtaattatacttaaatcaacaaagtagtaaactttatattactcctaagttataatgtgggtttagtcattctctgattcaaggaaatgttggctttgtaaaaccaaaggtaaccttctgctgttattttgtaggctgtggacggagaaatccctggaatgattggagagtcgagagtcggatgcaccaagccgagagagaaagccaagtgcaccgtttagcaaatgatacttagggtttatttctctttggttttttgctccatgttacacacccacatacttgtaagacagagcagtgaatggcctcttctgtctgagtccaaagcccacactctgtctgctatgtcacactattatgacatacagccattaacccgtgctaatcacctatttcacttgaatgacccaatataacaatgtgtggatttgagagacaatctcatactaaaaacaaacaaaatgaaagagaaacctgttataatatgtagagtaccttattacaaagattcagaaccacaggtcaaatagcatgctctccggcaacaatatgataaaattctttcctaaaaggaaaattccattgaaaacaagcactttttacatcctaggagatggcccataacaacagtacagtatagagaataattttccataaaaaaatactcataaaatcaatgctgttgttttttctggtccccacccatttcatcttcattttctagaaaccaaactgaaatgatgtggctgtttacactttcagaaggagagaacacagaaagctgagtgactgtgactcagagattttgttctacccccgaccagcagttacccttcaaccagtctcgctcttcatccctcacaatgcaaacttcagagtcacactgccagaaacaaacccaaataattcccaaacacaccactagaaacccaaacaaaacactagattaaaaattccagggtgtctgctgttcacaaaaacttgctggctcaccagcaaaaatctgggcatcagcactgtgctgtccacaactcctaaagacggatgtggctgcctccagtccagaaggcctcttcctttctgactttcacattattcctcagccaactgcagcctacttggccaacattattttcctcaccctttcacagacagcctccacctcctcttactgccctcacgcccaccctgcccaactgggttgtgtttatcctttccttccagccttctcctctaccctctggggtgtccaccgccctctcctctctagttcccctaaatccttgcccaatgcccagtttaggtccagcctttactgggtaacttttatccaagcacatgagcttctctctgccctgaaattctagaattctttccacgtagggcacagaatcatgaagttcaatttctctagttgttttttatatgatagtctcatcttttcatctggattaaaagtccacatcttagagtcccttgccatgccctccatctcaattagggcacttaaagccaaacagctgccagcattttccacaattacatgtattacattacagacacacatacacacatacacatatacacatggatacatacttataaatctatacatgatatgtaggcatgatatgtatttacacacacatcatgggatatatatgtacataaaaaatacggtgtatgtttatatatctaagacatatatgtatgtataaaacatgagatacatatgccttcatttattattcatttgtttgtttactgattgtttactaaatgctgatagaattttttaagaattaaattcctattgagaaggggtctcgctatgttgcccaggctagtctgaaaatcctgggctcaagtgatcctctggcctcagcctcctcagaagctgggactacaggcctgcaagactgcacccagcttggctgggttaatagagtattaacactaggaaaacaaacgcagaaatgttgtagcctcatcctgcatgctgtctgtagatgggaaaaatcaaactcagggaaattaattttttcaagactacacttggtagaaagcaaggtatgagaaggagctaacaaactaaattccacaggaaaacagcataaatattacagctagacaagaacgctgatggagaaaatttcccaatagaggaaccattaggggttcctgaggcaaatataccctatacagtgcagattgtctatatatgtagctcactatggcccatgacatattagcatgtgaatctccttcagtgttattgataaaaattcagattcctcaatgctatctgagagctatctaatctgaatctccaggtaaggtccaggaatctatatttccacggagtcccacaatgattctctgcacaccacagctgagaaccactggctctaccctatatcaagctgacaatgagaaagatataaaagactaggcagatgctgctggacttgagatccccattcccaaggagttaattcaaagacagtcattgctcataaggctaaaccaagtggtccaatttcatttgcttattcttcattcaaaaaaccacttttctaccaggcacagtggctcacacctgtaatcctggcactctgggacaccaaagcaggcagatcacctgaggtcaggagtttgagatcagcttggtcaacatagtgaaaccttgtctctactaaaaacacaaaaaaattagccgggtgtggtggtgcacgcctgtagtcccagctactcaggaggctgaggcaggagaattgcttggacccaggaggcagaggttgcagtgagccgagattgcaccactgcactccagctgcactccagcctgggcaacagagtgagactccatctcaacgacaacaccaccaccaccacaaaaaaaaaaaaaaaaaaaaaacaccttttcacctaagtacctcaaggccctccaccaaaaaaacaatgctctcttaaaactagctgaccctttgctctaagcataaagaaaaacagaagcacatgtggcattgtgaaaatgacctattctcaattttctatgtctatctagagctgtggcattcttctaattttttttcttttaacttagagttcttgtccctaaagcagtggccctcacaatgtagtccctggactagcagtatcagcatcacctagaaagtcaaattcttaggccccagctcagacctgcagaatcagaaattccagggggcagggccagcattctggcttaatagacccattgggtgattccgatacaggctacagttcgacaaccactaccctgaaggaatactgggagaagaggagtttccattagtccttctcaagtctgagcctcctctgcttggggaaatgggaagaggtgaatggcaggctgagcaagggagatccaggcccatccgctcccactagtccatctgcaggcatttcacacagctggctttcataacaaagcttatcctgagtctcaaagttgatactctctgaatatcaattgataagcttaccaacatgttaaaacaacaaggcaacacagcaggcctagtatggaacacaaataaacgtcacagaatctgaccttaaaagctggatctaactgaaaaaaaaaaaaacaaaaaaaaaactggatctatattctaaaattaatgggggagggagggctggactgatttaatttagtgagaactgtttcttttaagtgaattggttgatttaagtcctacaaccagtttctaagcactcaatttcaaattaaccagttgcttgaataaaatggtgaattttctttattttcttcaagacaggctcatgtggctatgacctgaaatcagtgattaaagaaatgcttaatggtatctgcccattactaaattattattattaattaaaagtttaaaaagaaaacaaagcttacttttgtctactaatggatacagggatttaatgttacaaattacctttctaaacccaaaatgcacaaggaagtgaagtatacgtagaaaattcatctctaaaagcatactacccaccaacgactacctaatttagcagaatatattacctctatgcttcataaatcttaattaaagctgttagttttcctattatgtgatcgagaaatgccccattaaagttaaacagtttctacaagtaattatacacatatacactttaaaattgcttcatatatactggaaacattgtctactaaatcaaaaacttgcagaatttcattaatgcaagatttttttatctcccaaaagtcaaatgtgtcccagaggaaccagtatactcagtgttggcttcttataatacaatttaatgctcacaaacacaactaaagtatttaaacatttacaggggttgtcataaatgcttttcttatttttgatcaaattcaaccttacacttaatacagttaactgtagttatttaatttaaaaacttgagattccaacctcaaaaatttataacaatataaatgcagttacttggctataggatacgtatactgtggggactccattcttcaatatgaaacacaaataccaaaaccagagaggtagtattttttaaagtagacattattttaaataacttttggcacattgaagaaaaaacatcaaatccaaatacaaaaatagaattctttcattcatatagtcaatttcaatcagacactagcacaccaataataagaataatgtttatatttttctgttttgaaaaataatacaagatgaatcgataaactagctaattgaaaatataatgttatttgagggattctagacatcctaactgaataattggatggaaaatattattgacaacttctccattttctcaaaaggtgtagtttatttaattcattgaaatgttacatgtaactctttaatattatacttccgagagatgtgcaagtttcatcttcagaaactgtcactggccttagaagaaaacacttagatgtaaactcttgtgccaagagctttctgtcctggggcatattggatgagcacattcacagaacatgaaacaagagaaggaagacagctgtagcccaggcggtgatggataacccttgatcgggcaaacgtaatatctctgagggctgaaagtacattattaattgaaatccttggttagttcctccttgtagaccaccatataattgcatctctacctgaaaaactgttttcagcagaattcataatgggtaaagtgtcctcaaaatgcatatgaaggaaatctattttgcgtacaagtgattatatcacaatgtacacattacagagacactaaatccttatttccatgactgtacacagaccagaaaataaatgcaagcagtttaccgctcaccatacagcacagtaacaattaaaatgctgtttgatcaaaaattaaaacctaaaaaacattaaaactaaaaaaaaaagactgttccatagaattagtgtttccagttagcaacaaatataaatgacctcagtgtattctgatattaaatacaacctccccaatataaatatcttatagttacaaataccttagtttaatgaaatgcctcttcttttgtgactatattttatgaatataaattggactagtcaaacacattagcatttttttcttattcaaatagagtgtatcaaatcttgctggtttaaaaagaaaaagtttcttaggacaatgaaagttttatggggagttgaggggttggaaggaggtgaagaggtgcatgtttccaagctagggtataggaaagattaaatatctcactgaacttcagcctgacatggaaaagtaacatcacctaaaatctcaatcttatcaaagtgtaagatgaagtaaaatagaagacagggatacattaagagatgttcaacataagttttaaaaataggtacagtaataatgcaatccactaataaactgaataaggagccgggtggagagtctaacaaccagtcatactaaatgacagctcagagggcgaagaggtgtggaaactgagaagatagacttccaagtcttttcctgaaagtgcttagattttgagaagagtccaatattgtcagacaaaagagtctttgtgcaacaacaccagggaggtgacggaaagctgctcaggaaaaccaacatagacagccccagccttgtacacaggacccgtggagaactttgacttatggggcctgcagaaagaacaatgctaaatgcaagagcatcatattcagccaatatcagaatgggcacagagcagatgagcagatgtctttaaaaaatcatgttgggtttttttctttcaaaaaatataataagcagatacacagactacaatttcaaattgcatcagtagtcttagactaggtcctcagacatttgaccactctgggtgatttaacctgcctcacaaaccttgatacctctggttggcaggggctctgattttgagttcttggtgaagtggcaaaacagctcatgagggagtatcaacacacaaggcctaatatcctgaggttcctgtcccagaataatgaaataggagcctgttattattaaaggaagactggtgtcatacagagacaatttcaaatagagaaatacacactaaacatggatggtggtccactgtttattcaaattcaggatatctacaaaaacttaggctgtaaatcaagtaaacacatcagataattggcacttccagcgttagggagagttgtccaagcttttgcccctacaggaaaccataataaataagagaaaaacacccagtatatcaacctttctggatcttcaaaatagagctgcctcataagttttaccaggatgaaaatattaaaagattcataataagggtacaaaaaattcatttttctccttcaccatttccaactgccctgctatcaatctgaaaataatttaagtgtttaaaggtatccaataaacaagcaatgtccttaaataaactttaaaaccaggtgccaattttaaattagcattagatgcaattttatcttaaaatggcatcttcgcagctgtaatttccatcatatgaaataaacagcaagttataaaactggctgaaaatttttcaaaaatatacatctgccaataaaacatacaaaaaagattcaatctcatacaagaaccaaaagaaaatagggtgggagggtttactgtggaattaaaatgtaagaagatagcagaacaaagtcttccagtaactattttttgtagtgctaaattctgtggtgtaatggaaacagcatgatgtcagagacagaagcctggttttcaattctaccgccaccttgaactagccatgggatcctgatctgtagatttacttcattcataaaggggggtaatgatacttttcgtctgagtgtagtatagtgagcaatttgcaccgcagttggtgcatataaactcttaataggtattatctgttgacgttattatcatcatgagttgctagatcagatcagctagcaaagagaagggtcttaagaaaacaggagacaaaaatggatccaaatgaggccagagtgaagaagaaaatatgggactaggcatcaaaaccatgaaggtcaaaggaaagagaagagagaaactttggaaacatcacaggtcagactgtgaccttaatgaatatgatatgtgactgcctaatagaattgttattgatatgacacatgtagctttagaaacaaactacactaaatgcttgcactgggcctgtacctgatcaaaacagacatattcattcataccactctgcttccatcattcagggttttgataaaacgttaaacctcatcctcacaccttaaatgtaattttaccaaactaaagtaaactgaagtgagctacaaccgatagcgaagaaccctatacgcattaacgtgagccacagtttaaagtgtgtcccctttagcataaggccgggcacggtggctcatgcctgtaatcccagcactttggaaggccgaggcgggcagatcacgaggtcaagagatcaaaaccattctggccaacatggtgaaaccccatctctacttaaaatacaaaaatcagctgggcgtggtggcgcatgcctatagtcccagctactcgggaggctgagcaggagaatcacttgaacccaggaggcggaggttgcagtgagccaagatcaagccactgcactccaacctggcgacagagtgagactctgtctcaaaaaaaaaaaaaaaaaaagtgtaaacctgtatatggaaaaactacatagtgaaagtctgctatgatacatttaacttttagacaagaataagctggttcccaatataagctttgtgaagatgttccattgtaccaacaatcaattctctcactgggaatggttgagaaatggctttgttgaccaagtgctatactacacataaattagcaatttgcaaaaagagaaagaataaaagggaaagaatcaaatacactcaacaccacaacatgataaatatgttgattaattccctgatcattcaaagagatattcaggaatttcaaagactgtacatcattataatttcctttgtcttctagatgtaggaacctgccagttaaaaggaagtcataattaacactatgccagttgaagatttatgtatggatatatgtaatattctgcacaactacctcttgacttacttttttttttctgagacagggcctcgctctgtcccccaggctggagtgcagtggtgcaatttcagctcactgcaacctccacttcctggactcaagccattctcgtgcctcagccacccgagtagctgggattagctgtgtgtgccaccacacccagctaatttttgtatttttagtagaagcaagttttcaccatgttggccaggctggtcttgaactcctgacctcatgtgatctgcccacctcagcctcccaaagtactaggattacaggcatgagccaccgtgcccagccattacttataaattttttaaactgagattaacataaaatcatagcaaattataagtactccccaagggattaaaaaactaagcaaaaatagagaaagtcaagaattagtcacccatagttttctcaagaaaacagagtttaaatatataataggaaggtagaaaagtaggcactatatctacaaataattcacatgcacacgtatccctaaaatgtgctaagtatcatttagatgtccaaaaacaagaaacaccagttacccaggggccatgattaattttctcccttcaagaggaactaggtctgcaaaaggcttagaaattggtagactcaggcccactccaggaaactcggctggtgtttccattataaaccgcatttcaggagtttacaagttgaatgtttttaaaacatattgggctcataatgagctcacacattcttaaaatgttctctttttgctctcctttaaaaagtatggccacttttgtgaataaatcataaacaaaatttcaggtgattatttttggctgagctccaagacacaatggctaaatgtttgaataaagtaaaaagactaattattttcttcatttggaaagtagagtagaaaggccagcctgagaaacactccacaggacttccgttttaaagcattcttttgcaatattttcattcagtggttcaagatcctaggactgcagctaggaatatgcaatcaaacttcaaaaactccatttctacatctggagatttatgcaataatcgctccagcattagacttctctaaagttatttgtggtcaaaattacatgtaccatgaaagccaggaagactcttagaatgaagctaaaagccaggtggtaaggcacctacacttaggtgtcgccacaaacccaaattcaaaccaacctcatagttttataagccttttccctgtgccaactcccagcttaaaaatagtccagggcaaatctcagcaaggaactgagttgatgagtaggttaaggcttaaaaatcatttctttcagaaccagggggaaaagaagaacctggaggttctgccgaatatgaaaactattctccacagcatctctaacaccttttggggtttataaaagaggaaggcagcagagatgtcaaagccaggcatgcctcattcccacaaggaatagagcactgagtgtaactcaccaggcctcttacatgggaatgttggatggtacagcaccattgagttccagaaggatggtcctgcgccgcagtagaaaaacaccttgaaacaaggtagctttactgctaaactctctcaccatgcatggctgagttcagctgctgaggaaaaaggtgttctctctgaacctgtgaattgacaagattccccctattcacagaacaaccttccatctgcaggctcacgtcacacttagaagacatgaaaatgtgccccatcccaaaagaaagaatcacataaactttctaaattgcaactatgcaaaagacacaagtaacactgattaaaactgcacaaattccaaaatttaattgataatattctacatgtaggttaaaggttaaaaataccctgcaatgctgctatatttattgacaagggcaacttttccatctgtttctaattttatccatgattggtcatgagcctcaaaagaaaaatccactgctgacaataaatgaaatgaaatttgcactttcctataaataccatcccccttcaagaagaggaacccattaattaccacgtatggggaaagaagaattagtatgctaatgcatactagtgtcctaaatattgttcttgatcaataaacacacaacttcaaactcagaacattagaaacagagatatactctgatttgaatggtggtttaagtaaaaaaacttatgtatctgatatttggtagatggatatggcacctttacacaatgagtagccagcagccaactttccaaagattatgaacttagagagatgttctctattcgtcagctagcaaatgactaacttttccagatagccttaaccacctaaatctaaattatggaaataatacaagaagagaggctggaatcgggggaaaggagcctttatgctcaaatagtatttttataccccttctcactggctagtcagggacctgactcctttatccaccaatatcagatttctcaacctcagcactattggcattttggcccaggcgattctttgttgggagctgtcctgattgtaggatgtttaacagcatccctggcttctattcactagatgccaatagcacaacccactagaggctgcctactccttgtgacaaccaaaaatgtctccagacattgccaactttaccccagggagaaaaatcatctctggttgaggacttctgacgtataccaaaagaggaaggaaatatttagtcaaaaagaaaaaataaataacatttaaaataaatctgaaggcatagggagtttccagaccccacagagtcctcccttccccaatcactcatgagctgcagagctatgaaagtaatccacaagattgcaacttacaaaaaaactatgttctgaaagttttgaaatgctcgttagaaacataccaccaattttctccatagaaatgtttattatatgtggtgaataagttcacaggctagcccccaatacatatattcactcatatatgcacatagacaaataccacatacacacatatttaacttacagggaatatattattgtaatatcagtaattaaataccatgaaaaataaatattgaataacaaattatatacagtcacacatcacatcatgaggttttggtcaacaatgggccacatataaaacaatggtcccataagattataacagagctgaaaaatgtctgtcacttaagtgacatcttgatgatcctgaccctgcgtaggcctaggctaatgtgtgtgtgtcctagtttttaaaagaaagtttttaaagttttttaaaattttttaaatagacaaaagcttataaggtaaggatataaaaaatatttttgtacagttgtacaatgtatgtttaagctgttagcacaggagtcaaagtttaaaaagtttacaaagtaaaaaaaaattaccatacgctaagattaatttattattcaagaaagaaaaatttttgtatacatttagtgtagtctaaagtgtacagtgtttataaagtctgcagcagtgtactgcaaagtccagggctttcacattcactcaccattcatgcactaactcacccagagcaacttccagtcctgcaagctccatgggtagcaagtgttctatacaggtgtaccattttttcttttacactgtatttttactatacattttctatgttatgcaattgcctatggtattcagtacagtaacatgctgtacaggtttgtagcctaggagcaacagggtacaccatacggcttcaatgtgcaataggctaaattaaggtttgggtaagtacactcaatgatgtacccacaacaatggcattgtctaatgccacgtttctcagaaagcattcccaaacatacccctgtcataactatgcatgactgtgtttgcttatctcaaaacttaagaaaatgtcatttttactagatttatcagactgacagagactctgtagagagtctgaagaagctttttggcactctaagatctttggcagttaggagccctggattctttagggacagtttttaaagtttctaaggaagtttgtgtaattgcctttttctctaagcgaaaatttcccttagagaaagaaaaatgatacggagtggaggggagcagctagaaagagaaaagtattaatgagtatttgtgtgtaagcatgagaaagatttacctgcaaggcagtttaaattaactgagctttgatttaaatatacaaaagagagagaaatctctctctctctctctctccctccctccctctctctctttctctctctctctccctccctccctccttctctcattcacatacacatactcactagctcccctgaggggatgccgaggagtacaatttgaaaaccaccaatttagttcatgcttctcatttcacagacgagaaacctgaggtgtagagagattaagtgactggcccatgcccttgttaatgatgggctggaagaaagactctggctgggactactttgcatttgtacccctgagccctgtggaagcagctaggcagaaaactagactggaggactggacttgtgcagggaagagctgggagatcatggggtcagacagctgaagacacagggagcccaggaagtgtcagggacccagctgtcctctccaaaccccaggagtgggaccaaggacttacttccccagggctaccaagaggcagtctcccagaagagctgccctctgaaagggccccaaaacatcttaagaaactcaagagggacttgcagggcatccttccatgagctgccctctagaggaagttgacagagaacagaaaaacctcccatccctaaaagtgggcacatgacaacagaaaatgaagctgttggacattgagcttgtagaaacagtattcttgggggtatctcatttttcccttttcctcacatgtcttcatacccatcgcagcatgaatcctatttaagacagaatgaaattagtatctctttctgcttgatattatctaaagggcaagagtagaaatgctggtctttgtttatagataccattaagaaacacatacaaattcccagaggcaacattatacggatggaaggtcagaaaactctgagtgggaggtttagtcaattgcagaaatgccgaaaaaaataacctggctctcggattcctagacacaaaggtaccatttaaggaaagaagatgatatatactgcctcccaagtaactgccagccagtagacattgccttgagcactggacagaacaagtttagatccacctctgaaaaacaaacactttcagctatttcatggtagctgccatgtcccttaagctttattcaaactaaaggaaaactacacaaaggaaaaaagtagagttatatatttttaaactcagacacatgctagctcttactcttttttctgtaggcacaggggtaatagacattaactctggaagaaaagagattaagtgacaaaattttgtctgtatcacagaaatgagtaacagtaaccctgttagccctgtgtgctacagtgaaaactagacaatgctggagggtgccggtctgtgctagacgacaagactaagcaagacagaaagagtcccactggaaggcaggaggtgatggtgaaggaagagaagagtgaaaagaatgtcgtgtgatcaggtgaggatgcagtaccactaagaacctatctaggttgccctgagttgcctataggctaaatcatcaatgtattgattgatgctctggaaccctatgtgtcttttcccagagattatcattaatcttaaagtttacccaacttttttaaacagaagccatggatatcatgtggtaagtaatcatggtaaactagttttcataaatgatgtaacgcatttgatgctgtgaggtaaagtgaagtttatttatacctctgaatcttgagtgaaatatcatagacagaatgagagagatgactctgtaaagaaaccagaacctgaaaatgtgatcattttccaagcaggtgaaagttgactggtaggaccagtttaggagtggaaggaaagaatgattatttaacctagcccagatgccttatggttaatatttaaatattccaagtggtatccactactttgattagaaattaaaagaggccaggtgcggtggctcacgcctgtaatcccaacactttgggaggctgaggcgggtgtatcatctgagatcaggagttcaagaccagcctagccaacatagtgaaaccacatttctactaaaagtacaaaaaattagccaggtgtggtggtgcatgcttgtaatcccagctactcgggaggctgagacaggagaatcgcttgaactcaggaggcggagtttgcagcaagccaagatcacacctgcacttcagcctgtgacagggcaagtcttcgtctcaaaaaaaaaaaaaaagaaaaagaaatgaaagaaattaaatgatacccagtgttttaaatgataaacgtgttggtgtgcttctatgtgccagcctatgtttggtgttttacaagtattagatctactagttagcatacagactaagctgctgaaacaaaaccaccgcaaagtacagtggcttaaacaggaaagaaatgtctttcttttttgtataacagtcccaagttaggcaggcagtcccagacaggtaggaagctctgctctgcaagaacattcagggttccagattcctcctcgcttattgctctgccatctcctagggtattgttctcctccatatggtcagagctgactcactaccatccatctactttcccacctgcaggaagggagaaaagaggggaaggtggacaggaagcttctttttataaattgcagataatttaaacataattctgttcacattctattgaacagaatcctaatggcatgatcatgtcttcctccaagggaggctagaaatgtagcctataactgaatagccatatgcctcagtatagctcaagtcgtagtgttattaaaaggacagagaaggggaatagatattgggagaaaatttggagtctccgccattttaacctcattgaactctttccacaatcctgtattataatactttaaaaaaagttttaattttttagatacttacggaggcaatataatatctttataaatgaacaacacacttgaagctgttaataattctcccaagcgccacagcaggaagtggccaaggtagaattcaaactcaggtttttttgtctcgatatccatcttccttctaccacgctatgtacagtgtgcctaatgagtcttactccaacagacaaagcacataatatgaaataaaactcatgccatgtggcttttttcttaaagccaatgtctcttcataaaataacaacaccagcagaaatatttgtgtaagaaaaaaagtcagaaactcctttttagaaaataaaaagttgaggggagagggaaattgcaaggaatttattaaaataccactacaaaagatacttgaaaaaatttatttttctcctaccactataaaacaatcaattttggtggtgttgaccacaaatcgtattggtaagaatagaaggactcacgtggaatgactttcttgttattgaatatccataataagctggcatggaacaatctaaaacagcaatgggtctggtttggtaaagttggtgtgatgtgtgcacacacgtacaaacacacaccctttatgaaatagcattactgaatcctgctataatcttaaatccctacacacctgaatgcgtctatgtcatgagataaacactcgtagaataaaaatttactatcccacacattcattaaatttgcgtaagcgctttcaagaatggaaggctctgcttggggtggggttttatcccctcttccttcccctgaaatcaagagatatattttataatctacagccagctctctggcaaatctccattcttttcaacctgacagactgtttgtcagttaaactccccttgtcatgtatccctaccactgccaactcatgcacggagaccttcacttttactgctaccacttgcaccctatgcaacctttgtcattgatcactgatccgatccagtgcccacatgttcttcaagtgcctacacaagtaatgaggtacttgtggtgtaaaattaaactgtcaactgtcagcgattgataaccacagtgagagctgacctagaacacctgcaccagtggccaagacaggtgtgacgtgtttgatcgctgaggcctgctagtcagtctgacctggtgctgtccctccatgggtttccttgcatttcagcctcccagctttcctgcatacccctatgagcatccctagtttgcagaaaccaccctcacagccaattcgggcagctgatcagagtggccttgaaagcagatctcgagtcagtaggttggtttgaaagtaatatgacctagagattttcaaaggtggcatctggagtcagcctggtgttttttcttccacatttccccacatcccctcctaaagcgagtcttggtggcaggattcacacataccatcctccctccatttgtgtttccagtcatgtaccagtgcctggcaaaaggaccttcccttcagggcaggcacacggcagttattaagagtctggtgtaaggatgaagcagtcctaatggaactgccttatggctctgagcatttgcttaaaggcatttaagttgaactggctcacgttctgttaaagtacgataaatgcaagcttttcttactcatatgtaattgaataacctgcacaaaggaaaaaaacatgttctgctctgactaaaattgtttttagccagagttgttgcacagcatttaaagtttttatttaacagttttattatgtaaatgagtaatagatttttttagccttaagcaaaaatgcacttacagacctaaaacatcctttgtgaaaaatctgagacgcgtgatgggattctcatcccattacgccatctcacccgcaccaaacagttgcactatattaagttcatgtgatgagaagataaaaatctattaactttctgctgaccttatcgacacaggaatctctgcagacattacaaaagccatatctcttctgacttttacatccagagcctcatgctccaaagtcccaaaccaaatgtaaaatcttcatgatgagtgggaccctgacaccaattcagattccaggcttgctggcttgcagtcaatggagcctcctctggggcacagaggctagcctctactttgcatgtgacttgaggggccttttttttgccatatgctactggggactctgaatcaaaactatttcatgaggaccatatgttatgagaaatgcatgatggaaagtgaacagcaaaaagttgccccatatcactgggtgatgtattacaaacataattaaatctgaataatgtgcagtgttatttcagttaatcatttttttttttttgcaatttaagtgaggaaaacatagcccaatttccaaattacataccaaagtccagataagctaaagcagattggtgggagaggagtaaaacaagagctgtacacccttgtttaagcttctgtaaaaggtcttggtgtatttaagatatgttggtaggaaggtgacaaattatagtctctgtaaataaaaggtttaaaacactattcgttttcttttgaatcaacaatgaattcagaccatccccaacttataaacaagcagcaagtcaaaaagatcactgtgtgttcattgtttagaatccagagtataattaaaatttcattattaatagctattaggtttccaagctagcctatgaagacctgtctactccagctgtttctgaaatgtggtatttctactttatcttgatagcattagttacagggagaatggacaacatattccaaattcaatggaatttatttattcattctctactatgttttcccagaatatactgattactacatttccccaaaggatatcccaatttcccaaatgtccccaagctggaagaaatcattttctattctgaacccttggaatactttatttgtactcttataatcaccttctacctaaactacaggtttttgtcaattgagcttaactactccacttatttttatatttttatattactagcttatttttacatttctaacaccctagttccaagccctgaatttggcaagttctcagtacatatatatgtataaaagtggatgcctatgtaaataaaggaatacgatctactagggttgccaaacatattttcccctcagtggcactggaatcatgggatgtaatgggggaaagggaagaatatgataatgataatgacaatgatgagaatgaggatgataatagcaaataatattgtgtgtttaccatgtgacatgctcttgtctaagcactttgaaagtgttgaccaatttaatccttgaaacaactctgtatggtaaatgatatatatgtaatgttacgtgtgtgtgtgtgtgtgtgtgtgtgtgtgtataatatccctattttacagatgggatactgagcacagaggcgtcaaacaattttcccaaactcatacaaatagtaagtataatagatatttctggacaccagaaacatatttgctgtgtacatgtgcataagagggaatgcttccctacattactccagaatacaaagcttctttctgcctttctcatccacataatggaagacacttcttgggtgaaatactccacagttatttcagttctcactggtgagtctgaatataagctctatgagagcagggaccttgtcagtcttattcacaatatccccagcctctagaacaaggctggcacatagtagatgcacaaaaggtgtttgctgaatgaatggatgactgagtctgtgtggggtaatgatagggctaaggatgggactctaaactcaggtttcctctgtgggtttcacagtttactggtcttaagaggagagtttcctaaacttgccttatgataaaaaccaccttcagcatttgttaaaaattacccattcctgtagattctgagtcagtgagctgaagtggagctgataaatctgtttttgttgatactgctgctgctgcggtttttaacacatgcttcaggtggttctaagcttaggaaaccttgcccaaaggataccattctgtctcttgggaaactgcctctatgataggcatttgcaaattcaccaagagtgacagatagtgcctcgggcactgccactgtctcttccaatgcaatttgtacattatgccgaatcataatacaggccttgtacttctgcctcagctgacttgtctgtgggatcctgcagctctcaaccatgcggaggaacgcttccattcacacattttgtccccctaaccctgtcttttctgagggtgcatcaatgtctgatgaatgaatgaatgatggaataaacaccaacatgggcaaacaagcaagtcaggcagttgtgaggagtggaagtgtttcataagcttcagtttttagttgcacgtagtagcatacaaacaatggcaaaaagaatattaacatgtcctgtttccattgctttccttctgacttaaagagcgttcctataacagctaataatctctggacctcaaaatcactatatatcttttttaaaatattttattttccttagttataatggaacagatatggtgaccttagtacccaaaggattattttagtcttacagatatctctctcttccttattctcatttttattcttctttcttcccccagtctgataattatgtccagaaatcagtaaagaacatcaatcttggttgggataaatttaagtagctggaaatcataatatctatgatcctccagagtctagaacacggtttctaaatctcaacgctattgacattttgagccagataattctttgtgatggggagctgtcccgtgcattataaaatattgagcagtgtgtccctggcctctacccagtaggtgctagtagccaacctcccgaatctctagttatgagttatgacaaccaaaaatttctccagatattactaaatgtcccctgggaatcaaaataactcccagttgagaatcactaatctagaatgattttttaaaacaatgtgctttttaacatattagtcgatatttggtatttatgttaaaggatatattaatcaaagttgcttgaacatcaaacgaaaatatggacataatttcttaaagaaattgttggttcaaaagaatcatggctacccctttagatgtgaagttcaagagatatcaggcagaagctgaaatggaatcttgacattgctgagattttacaaaaaaatttgaaaggagggtgagcttgaagactaactaaaatgtctcacttttggcaaaaacatccaaagtgtaatgcactttgccaacagctttgcccttggctttttgtcttgttttttctttttaacttaagggtagttcaagggtagttttaatctgtatgttcctggttcctataatctaaaaatcatccaaatgctgttttataagagtatctcgtaagctttgatgtccaagaagcctgggggccctttttttatgtgcttattttcttttgaaccaggaaattgtgttttgccaagagcaaatggaacttgagcctcaaaagatttgagctctgtttgaaacatagaacccacaaattctctacaggttctcaacttgataaaatacgtgctttcaccttccctcagaccaaacctctgctggttctactttaaatcaccattagcactgtcctatacacctaaagatttccccacaagagaaagggttaggccgtaagtctgaattcctgacacaacactattttcagctggactcatcatcaaaatgctctgcaaggtaagagaagagaagttaaatgagaagacagagaaaaggtgagagattcaactaagtaactaagaaagtcctttgactttccccaggaccaaatccagcaaacaagagattacatcaaagttaaattgtttacatattagatgacctgttcatttttttccttaccattgatttccacagtacaaaaatattatttcagtggcaaggatgtaaaccttattcataacaggatttcaaccacatcctgagaacgaagcatctccttagatagtgtgctctcatttatatcgaagacatgctggttttatttgtcagtgtttgttgagaggtcacaatatcaggaagcaggagatggctcatcaaagcgtctctgcaagcccctactactcatcaattagacagcaccttgtttttaacatcggggcggaaatgcatctcccctgacccattgttagaagcttccttctgtctttaagttttttggaagggacactcaggactcgacttcttttttccaataggtaattgtcactaattaatgctcctgctgcatacaagaatgtggacctgtgaccctgagtaatctgggtctgtatctctggctttggagcaaggacactctaatctcctgactctaaccatgggggcccaggtcacagacacaagacttcccgctgggttcctgagcaggccttactctgcttcaaagccagtgagttcagtggggcagcctgacttcaaggagaatgtggcatctggccagtgaataccttctgaggtgagatgttttctctgaaggtctggagatctttctgcagaaaccaaggtctctagctctattcattccacattcatttactgggtacctgttctgtgccagtctctcacctaggcacggaggataaaatgagtaaaacagagtcccttctgctgacaaggaactagaactaggctcagtcttagccccttgttaaaataccctttaaagtgtaactagataaggtggtcttatgttccatcttttagatctaatgtttttgtttaatggtgcttgttattttctcattaataaaaactgatgagctcacatatgcattaattcatctcatttcaccataagattcttcattcactttccctcccttctcctctcctctcttttcttttctttttcttttttcttttttttttctctctctctctctttctctctctcatctctttcccacacacacaaactaaagcatgggaatttctgatgagcataagactcagaatgactccaggataaaaatatatctctttcccatactcttaacaaaatactagatcactgaggatgcctgtccaaaattcctccctcacttaaacagagctttaggttttccttttcctctagtgaagatctttctccaaaaccgagcctagcaactaccctcatgcatatacaccactggattaatttcaaatcaataaaaatgatataaacaaatgcccaacattaaaaaacaataaggaaactctggacttcaaaatagttaaacaaaaggctggttatttttaaaatagtcttcatattacaaatgtcggattcctttgaataaatctggcccggattcctttttaaacatttatggctgcttgatttccacggttcaagaacctatcactactaaagaaataagctacaaccatgtattatgtaattaaacaggcctaagtgatagaaacaaatctaccaggtaataagcagtgagctctgcacaattctttaaaaaaaaaaaaagacggtctctcactatttcgcccaggctggtctcaaactcctggcctcctcctgcctcagcttcctgggcagctaggataaaaggcatgagcccacacacccagttaagctctgcacacctctttttgggttatactgctagtgcacccgcttcgggaagacagcacagcacagcacatagaaagactcaagctgggctgctaagttcaagtccttctcctccaccaagttcagcaagttatccaatctgtctttgcctccattttcttatctgtaaaatggggggttaataatcatatattagatgagttcacatctctaaagcgtctagaaagtttctagcccatagtaagcactatacaagtgcaaatactaatacatgtttataaaacacataggctcacaaatacatgaccctatacttaaaggaaaagcaggctagagagatgttggaaatagttgttaaattggcttaactttctcaggacaccttgtacccaccacgttcatgtctcctctagccaactataaagttattaacacaagaaccctgtcttattcatcacagtatcacccacaggggctgagacagtgcttacacagaaatggcccttgataaaatatgggctgaatgaatgaacatatgaatttgatactttgagaactaaattaaaagttatttctactagcatttttaacacaagaactattgagattacttatatattagtagtaaaatgtttgctttattcatttgattgcaaaacttataatgaactcagtgaaacttgtccacctttttctacatgttgaaattttcaaaaatccataagattactcctcacacacacacctccaagtatccatagagatggacctacttcataccattatattcataatccaattatttctagaaatcccattgatttcagggaactgaatttgatagccaggaggcattccactggcttcttaaaggacattattggttttcattttgttttgttttgatttcaattgcaactcaaacaatgaatcttccaaagatggttaccctcactctacaaaagtgctaagttaatattctttaaaataaatacaagcatttcttggactagataccatcaactttaattttatttttctcacataaatgttaaccaaaaactaaatgataatttccttctgtcacacagcaattccactgtggtggaacaaagtgttatctcaagtttcacagagcaattgttcaatcattcctgttggtggctcctttccaaatcttcgagaatggcccagccagccagcccttgaaactgggagtgggaggcagagggggagtcgctgtcagtaagagctcagctctgtggcatactggctggttctcccccaggagcatctcctacccatgaggacaatgcccaaagcatgctgcctgcttggggacaattgctgggaaacctctaaacattgaacttgtgcaaaggaggcatggaggcatcaaggaaagcttcatctcaccctattttggtgaattaaattctcacgaagtttggggaagaaaagagggggctcagaaaaagaaatgtattccttagagtttttttggttttggttttggtttttttgtttttttggttggagatagagtcttgctctgttgcccaggctggagtacagtggcacgatcttggttcactgcaacctccgcctcctgggttcaagcgactgtcctgcctcagcctcccaagtagctgggattactggcacctgccaccacacctggctaatttttgtatttttttagtagagatgccatgttggcgaggctagtttcaaactcctgacctcaggtgatgcaccagcctcagcctctcaaagtgctgtgattataggcacgagtcactgcacacggccaatttattccttatagttgaaaagcagtaacaaagatttcggcttcactgaaagaaaacattgttcaaactacatcacctacctcctgctaaaaatcatctacaaagccaccctttagagttgggtcaattaatctttctagatagactgctcaaagaggaagggaaattctgatacatgttttcctaccaacttccacatacagatgaagtaggtttgttgaaccttagatgcatagagctctgagcccatttatgataccaaatctgtttgtaacataaatcaaccaaatgttggaattaaaatgagtatagaatagcttaaagttaataatcaattctattctccaattccttgtaagtcttgaaagtttgtgacacaacagaaactagggttatatctctattttcattgtattttcttcgccctcccacaaaactaggagcaattagtcaaacccagtatatttttttaagatatgggagtggctttgtagaagaatggctttccccctcacaaaaaagtctagacttcttcaattaaaagataaagaaaattaaaagacccctaacagaggtaggaccataggtaattattattttttatgtatttctatatttttataaccttacaataaaagtaaatcatttgcataatgaatatttgtgtgtttgtgaatgttcatgtgcacccagaaggagtcttgacctgacttcaatgtttacataaatcacctgcgaatgttgttaaaactcagattctagttcagtagatctgagatgggcctgagagtctgcatttttaacaggctcccaagttactggtccatagactatactttgagtggcaaagtatactgtatagtgcttgtctgattaaaagttccactaggtgtcttctttcctgccagtccaaatgaagttaagaaacttgaccccaacactttagagcaacaaccaaagcagagttagagaaaagctgacatcacttataaaacttggtctgcggtgcctttggtttttctcttctttgagcaactttggtctataaagacttgtcccctacctcatattggccagaatctagcagctaatgggaggggcgggattataaagggagaaaatttcatactgataattgttttagccaaagaatgggtagcccacctgccatcagagtctataccaaccatttagaaccatgaagagagtttcaggccctgaactcctgagccttgaccagccctgggacacttcttagaacaactgtctcccctctcctgtctcaggtgagtggatctttattcttcataaccttggctcctcaaccctcagctcctttgcactgagctctttccaagctttctcctccttcatagctcccaggcagaccctagacttttcttcctctcctccttaagcttctttgtcttccctttcagtgccatcaaaatgagatcacaacttcagatctatcattgcatctagtcccaatatggggccatggcatatagttaatcccattttagaaacaaagacatttccacatagaaataataagtgacttgtctaagaaggcccaacaaataggtgtcaaggtgagtttgaaccacacacacttcctttcgtttactcccactagcccttcatatctcaaccagattatatttcataatggcccagtagctttttacataatttgtcacttcagttcactttatcaaaaatagaaaaaataggctgggcggtggctcacacctgtaatcccagcactttgggaggctatggtggggtggatcacgaggtcaagagatcaagaccatcctggccaacatggtgaaaccccgtctctactaaaaacacaaaaaattagctggtcatggtggcgcgcgcccgtagtcccagctactcaggagcctgaggcagaagaattgcttgaacccaggagacggaggttgcagtgagccgagatcacaccactgcactccagcctggtgacagagtgagactccatctcaaaaataaatagaaaaaataaaatacagctgataacactgggtcattaaacaacaaccgataaatttcaccatggcttacacccacctaaaaaaatcagaataattctggtttagtaatattaatttgccttttgcttccccactgtatgtgagatatagagcataaatcaattaaatatttgctcagtattagtaataaaaaatacgtgagcatttctcaaagaagatagtaaaatctaacacaaactataaagtaggcattatacctaaaagccaccgtcctctaagaaaaaagacagttgtttcttctgcttagtagcagcattttgttgaagctggtaatctgtcatctaaacatttaaaaaaaaaaaaaagtccactcttttctactaaagagaaacagctataaaaaccaaaccagattgaagctaacagcaactggcctgcaaaatatggtggcattttcacagttaattttgctgccatttgtacctgaatttatcgtggttctgaaaaagtaaattgagaggctaacacagccctcactccgggtgcaccggccgcagcgcatccccagtcgggctggatatttagtgccgctgtgctgagaaggccgaggagagagccaggggagggattactgctcggtgctgcccataaatcaaccgcaacacgtcacacagctccacatcccacaaataaggctgggctggagaggtgtcaccactacacaaaaggaaggagagccctggatgcctttgcccacctggcccttcccctcctgggtgctcatgaagcagggaggcacctcaagattttgctgtcacttttctcccctcactgtctctttcctcccttcacctggggagaagattgggccccaggtatccagtgattttaacaaaggcaggccaccaccgagccttaattccaaagtcccttctcacttgctagttaaccacacagcccttaccttgttgactgggcttcctcctgaactgaagacggtaaatcaagtgtctcctccacccccagggttcagtgactaccaaagaaatatctgaacagccctactctccccttctgcccaagaattttcctcagaatatgaaaatcagggtttttaaaatattatttataaaaacaaacttgccttcctttttaaaactcacaccaccctgtaggaggtgctagtcataaacgtgcagaggctgagaactgttggccccaagggccaaaatgaaaaacagcaccctggtgtccccctgcggaaccagcccttcatgttctaagacagtcatcaacatgattcctgaaaacaatagcggcttcttgtttaaaatggaactgcacctgctagaatatcgtgtcaacaaacaattgctttgtttttcataatagccatccgagccgaagcaatgggacttcctgaagtgcatactggaaggcttattcttagaaggggacagaattctcattttaacacaaggctcagagggccagagtgatggtcatcttccttccttcttttgtactcccctgtgttcatcttatttggttttcaacaggtttatttccattgcaaccctctggcttccaatgcccataatgccatattaggcaaataacattcatttctgcttcctctctgttaatgacgaaggcctttaattgctattccaccatttcaaacagttctcagaagcttcttccctcctctgttgaaagaattgggatgaagcctgatgaaaattctttgccaaatgttcaaccattgctaaatcactctgctctttcattttagtcatctaattatgatgtctgcttccagtttttctattgccctttgatgcttatctgttgaacaaattgtgacacctttaaaaggggttattttggtaaaataaggtgcttggttctgattaaaaagtgttttaagtgattcagccaaggttgtctccatgggctcaggaagtaaccacagccaaaataccctagtgagggcagaatatgagaggccgataatacctattgttaccttcgtcaaggtgcagccaggcaccaggctcatgggagcaagcaaaggtccaggcctctgacaccgcagattctaaagcagccagagctagcgataggtactcaacaaggaactgagatctagtttttttaaagtatctttattttcttttctgtaaaataggagatagaagactaaacactaggattttatgctattttgaaaatgaaaacgtagcatgagaaatattgcctgatataggaaaaagagtgcagggcttaaagtctagattcaaagagctctgcggtcttaagaaagtcactttacctctctgagcttcacatttctaatcaataaagtgatgctgtgaggccagctgctctccaatttcccttgcagcttagaaagcctaagatgtctactctagctaaaaaataaaccaaccttataaagaatttaaaacagataaaaattgtctggtatatcagctagtgttggtgaattttcctgttaatttgaaactttgctctatttcacatttcttaacctcttaattgagaatttacataacttgtcagcgtctcactatcctaatctatagaatgggcatattaatagcacctgcctcattgagttgttgtgaggaccaagtgcactgctacatgtcttcagaacaatgcttggcatgcagaaagtactccataaatgtaagcaactagtagtcataatagtagtagcagttgttgtagaatagctctttgatttgattgtttataaatgttttcaaaaaataaacaagctggccgggcacggtggctcacacctgtaatcccaacactttgggaggccaaggcgggcagattacctgaggtcaggagttcaagaccagcctggccaacatggtgaagccccatctccactaaaaacacaaaaatcagctgggcatggtggtgcatgcctgtaatcccaactactccggaggctgaagcaggagaattgcttgaacccagggggtggagtttgcagtgagctgagttcgtgccactgcactccagcctgggcaatagagtgagactctgtctcaaaaatgaacaaacaaacaaacaaacaagctaaggtaggagttgtttttgtaacctcctcaaactgtcaataaataggtgcccagaacatctgtagtgctagctctgcactgtcactctcagccctcaccattacctgcatcattgacaggagaggtaaggcaaaaccctataaaaagaagaaaaacttccttacgactccaatcaagagacaagacatgagataaaacattggccatcaagtttaaaagatgataatctgtattttaagcactccaaactctctttcttcatactaaatattttgaactgtcacacagatgccaacagaggtttgtttgtttgttttttgagaagaagtttcactcttgttgcccatgctggagtgcagtggtgcgatctcggctcattgcaacctctgcttcctaggttcaagcgattctcctgcctcagcctcccgagtagctgggattacaggcacccgccaccatgcccggctaatttttttgtatttttagtagagacagggtttcaccatgttggccaagctggtcttgaactcctgaactcaggtgatctgcccccctaggcctcccaaagtgctgagattacagggtatgagccactgtgcccagccgccaacagaatcagttcatttttaaacgaaaggagttagactaacatcacttccagccattggactccatgtagctaagaccccacttactttgggtcacacgctgcaaagagaatattttcagagtgagcaagagcagaaggctctgtgcctgatactatttgtggtgcccactcaaatatatctcataaaacatcaacttccacctataggcaaaggttatatcacctattcctgagacacttttgtcagaatgcataagttagctaatatcagtgggagttaatctgattaaataacttctcttttattgtgtgcctggcactgtgttggcaccagagtttcaaagataagataaaactctcatgaaacgaagccatactcttgagaactctcagatagtataatatagtggttaagtgcagaggcgctggggtcagactgcccaggtcatggttgctagaaggaggaaagacaggtaattcattaaaaaaataaaataaattccacctcacaatcttttcccaactcagctctgctttcaggttgagatttactgaaacgaagatcagatgaaaagagtaagtcagaacttctgtaagccagaacacttctttagtatacatctgtgacacagaactaggagagaaatcgcacaaagaagggatcattgagatttgtcaagtcacaattcagattagatgtgaagccccttacctggactctccattatcagatggtacagtcaatgtcatcctaattaactgtttgcattctcaacacctgctcattctacattgaacctacgtaatctgcatataaacccaatgaccattgatgatttgtgcaaactgacaaaaataatactgaaaatgtatcatggttgcagcaatcaaaacctgctcttattcatttattctagttcaatgtgctctcttactaaatgataacacttcacaataatatgattaagtattatcgaagaatgataattttccaaaactacaaaagtttcactgaacaagcaattaatcaattctaggagttctatgatttatataaaaataaaaagccagtaataacccaaattctcatcctataaaaaatatagattaatgtttgaaatatttgttgagtctatggccataccactgtctacagccgtaccatcctgaacatgcccaatctcatctgaaatatttgttgaactatttttatctggaggattgtggtttacattttctggatacacatatatgtaattaggatgatttggggccatttataagttcataaagtttaattctcctctactgaccctacttggcccttaaaaaaaatcatctaggaacaaaaaaacaaaaacaccaatttttagacagataaaatgctgtctcctaaaacacacacacacacatacacacacacacacacacacagagacacactggtcttcttctgatctttcctttagtgtaacaaaaaagttattccttaacatatttcccacctcctttcttcatgccttctcattgctttcccaagctgctcattccaacaatgcctttaactctgatgactcttattaaacacgactacttaattaccatcaatctattatgctatgtacttcaccctccactgacacatctgatcccattatgtgcctgacctttaacggtcatcaaatcaaagtcattctggtcagttcagtctgggcctgacacatgcccaggtcacagagatgaaggcgcaggggcctagcataccacgttaccctgcccttcacttaacacctttgtcaatagaatttcacaactgggaaactgccaggtttctgcctggcttgaataaaatgcccctccttttacagaaagctgaaataaataattacacacatgctgaccagcactggcttttatgtaattggtgcctctctaccagcatgacacactgccttcttggatgtttgtgctgaaaaatctttgcttggaaagtgagaatttattgtgcagccttctagaatatacccagcactccacactggctgaaaatcccctaaagatataagagagatggaaagacaagttgaggatggccacagcaacaccaccaagtgggtggccgccttccactgaaaggccagtccacggaagcattctgggttcacagacttgtgtgctaccctctgatgggaacagctgttcgggctgctctgtctcaaagctgcatgctgaaaaacactcccactcaacctaatgagacagccatttagaaaagaggctcttcctggctagtagggcctggtcattgttattcacccacaggctttccctggtggtgaacatggaactgttttcccagaccaaacatggaccctccctcgaggtagccagacacactgtctggtgtgcacaaacattttgacttctgactggacagctagacctggcagtgtcttccccttgctttactttactaatgcgtgtgtatttttaccagcccctctgggaaaactgccctgctttatagcaacttgtcactgacaaggaatttctcatcaagattgaaatctctggccatccccaaagctcccaacccttctgagtttctgagctcaggacaaggagatttgtccttggaaaaaaaaaaaaaaagaaaggaagaaggaaaaagaaaagaaaactggctttaggaagcagtattgtggttttttcatggctgtgatgaacgaaaaccctcccatagtggcccaaaggcaattacaaacatttggcatgtgacaaattaatagtgagacttatttcttagaagaacaatgatttgcttagatttttttaaatttctagattctctagaaattttccaatggaatgtgtattaccttattctttttctcccacctcctccaaaatataccaatctgagatgatgaactacatcacctatttagctccctcttctcactctcattcctgacaggttaaagctgttttcacaacagttttctctttttgccaggctcttaagcattgcctattagtaatacataccaaatttacttaaaagtcttaacatagggcccataaagcaacacaaccctctaataattgtatcagccatcgggctgaaacaagttcagttccctgaaaaataggaagtttcactgtgtaagaaatagaaacataaataataaatcagaaaaaaagacttcaatcccattatcatctttcatctgaaagactgaaattcacagtctttccacaaatcacttcacttgctatcaaatgtcttccaaaagactctaaatgtcttctaaattgaagttaattgttaaggaaggatacactcaggtgatctatcattaggcccagtaaaaatatttggcaatgtgagcttcgtttccatctgagaatctcaagacaattgaccagcaatcagaaattattcccacattaggagagatgatcggaagtacagatcctacagtaaatacaaacctcccatttcagacccaactcagatttattaccaaaaaaattacccatccaaaaactagcatgttgaaaatacagcataagctattatttggtatgtaacttcttatattacaaccatttaccacttttatttccaaaaactcattttattcaaaagtttccttatgtaagtgatggttctgaaggcacaaaaatatctccaacattttcctgaaatttttattggtttaaaagtgagtaccagaaagaattcagataagcatgacataggactggtgtgtttataacagcagctgtatctgtttgcatttgtggtgtaacttatcctcaccctcctaaacctgaagacccatctctactttgattgacaattgtatattagaggaattctcacggtaatatgtacactatgtaaatttctctatgtctgactggcataaacagactttgcccaattaaagagttaataatcattgagcggagcttgggagcagaaggtaccctgttgctttaagatacatttgccctcaaagtagttaacaggaaatttaattcataaagtcttaggaaatgtcacatctgtaactattcctctctctctctctcactcaacaaaaagagcctcgactgatctcattagaacactgagatgaactagcctgtggtgagtagctcagaggtttggtttgcccagggcctgacctccacaccagccttcctctccctcgtgatagcaacaatttcaagttttaaaggattgagcagcctagcttttttccttacatttaaaacacacctggtttctaggaacagtcttcagtgtttcatcctttacttgattatctcagaaatgttggaggccttgaagatcctggatgtcttttctctgctccttgacaattccatgtgaattttaaggtttcttttctctttttttttttctctttcatcttatccctgcttctctttttcccaaactctcaaataagtggggttttccctttctcagttcttaatatgtctccataaacatcttaccccagtgagtacacacacatgcacaaacacacataacaatgctatatgagggttatgtgaatgttcaatgtgtcactaaaattgctgatgttggtctgtatttgtaataccttaaagaaggatcaatcaattaatcattttaagttctgcttaaaacaaattacagcagtcaaaaaagtgatgcacaaccccttaaacaatgctaatgtattcttgtgaaaggatccaattgacagttttacgagactggagtctggtgaaagcaggtgtacacggcccagcaaaaatggcactatgtcgtgaggtttgaagggagatgcgaaagtcattttatgtggttggcctctgcagagcctcagagaaatgaggcagcagcgaaaagccatctgctgccaagatacaagcacagctattatacttctcgctattcacatgatcatacctgaaactgatatggagtgacattacccagcagcttaattaatgcttttctacactgcatgaaatacacattggcatcagccaagcaaaggaaaaatacttaagtggattcttacattgaattacatatatgttgtactttaatcagagatgaacatgttacttttgaaataaaatctgaaattgttattccttacacaaggaaaaaaatcagcattgcaatctaaatctaaattggaatgtaattttgaatttctagtaataatggattctaagggcagcatttgaagctaaactcttagaagcaaataaaataattgatacttcttttttggtccacaatacctttttattttttgttttctgctctattttagactagcctttgttcttcttaattttaacttgtgagataaactaatggcctttaccataaagcacgtttataaacaaggacaattaggaaatcaggaaagaggacaagaattaatttacagttctgtgagcaagtggataaagctgcgatttacaccgcagatttgagcagtgctgtggtcagatcacaggtgacgtggcgggcctcaagcctgcctgtgcaaacataaagtcagagtcggagaacttgagatgcaccgactattttgcaagagctcaggaagctgctctacataccaaagagcacccccagagagaacttcaaccctttaaccagggtctctaccaagaatattgtcacctgccacctgtgaaacttcgagacagacacctctccatctctgagccaggaattcccacttcttggtgttcagctccaactgctggttttacacctgctgcggggaaagcctcaaatatcttagccacatttggaagtagttcattaaagaggttctaaatgcctatttttaaaaatatttttagaacactcaagagttttatagcacaggagaggcctataaaagaaaagtactttgctaacagtatatggaaggaaatttttcaaattaatttttagtgcacattgttgcttctgagagtttttgtttaatttttatagtgttagaggttacactcatcattttattaaaagattcaattaggtttaacatttatggagcacctttcctttgcaggcttcttggctgaggattcaaggatgaattagaagtgaccctatataggaagctcatggtgtggtgagacacacacagctatctctatacattggcaaggtacacacaagactccaaagcatctcaggggacggaacaattcattccgcagtgcagtgggagttcaggggccaggctgaaaaggcggtccagcaatgtatcaaagaagtgataacaagttctctgggtcttaaaggatgattcagagttctcaagaaggagctcagggggaggagcattccctgtccatgctagagatacagcacttgcaaaggcccagagaccaggaagcacaggtgctcttgcagattagaaagtcagctattgggccctgaggagcagaattcagagtggggcaatttgtggcattcatttttggccactccactttaggataaacatcctacaccaggcaaactttggcttactagagtacctctcaagcaatatgctgaagctaagtagatttctgtggtgtttgacttcccaaagaactcaaagcacttaatcaataaagaacaccatcccatcccatcccctcccctccctcatctcagtgtcttgctgctgcttgaaatttttttttttttttttgaatctctaaagatagccattggaggaggaggaaaagaaggatataaaagttatggtatatttatgatgtttacatataataaatatatgcattttacattttttaaatgtctataaatacaagatttatatatttgccgacatcataataccatgcagacaatgtggttttgtaatagaacacaagtgtgaagttttatgatggacttttttctagcctctgtgtatctgttgtagtatatatacccttgtttacagaaaatgtcacataatgaaatttgaggtccttcataaatgtagagccagagcaaatgcaccccagccccatgtgcccacccccatccagtcctttctaaatgtttactcagttaatactaaatagtaaactaataacaactctactccccagccgagagctcctgctgttggaataggcatattttacttaaataagtgttcttacgtatgagattggaaggctacatgtgtaagggaacgtgcatgtaggtaatgcctttgtggaaagtccacaccccaccccaagatctctcttgctaagattccaagctcactgcctctggaactactgaatggtcagggacaagtggggaggtttgctgtgggtcactctacctccaccactgccacgaaggcccatttcctgggctttgctccctcttcagttcactgcccagagtggagttaacggggacacacttcaccacctcaacaaccactggtggtccatgcagcacaggctgcccagccatccatcaaagcggagcctcctgagaacagcagaatgccagtttcccctgtcaacccacctctcccagcccttctgcggagccctgccaaggactagtcccagcctgctcctccattggccatctgaacaactcccagcatgatgggcagatggaaagagagtggcttgtgacgctctccacacaatgaagaaagaaacatgccttctctcctcaacacacagcagctccctgtcatgaccccctgctgccgttacaaagtcattagcatctactgtgcccctgggggtgagggaaagccaaaccccggaacaatatcatctctgctaaagacacaaaacttttgcttatggcacaggcacagagaattctggataaacaggctcagggttttctggcacccagtgagtggctacctcagaaagtcaccttggtttgacaaggggcccatgagaaggatggagtttggggcatttttctcttaatcctcacaagttatggggagaaagagctactattctggaaattctgcccccaaatttattcttaaaaaaaaaaaaaaaaaaagacagagtcacactcttgttccccaggctgaaatacagtggtatgatcacagctcactacagcctcaaatttctgggctcaagcaatcctctcacctcaacctcctgagcagctaagactacaggtacacaccaccatgtccagcttattttgtatttttatttttatttttgtagagaaggggtctcaccatgttctctaggctggtcttaaatccctggctagtgacatggaactacaaggctgtttgtttgtttttgttgatgttattttgctttcatttttcccatctcaggtagaacagcagcattttgaatctttctctaccatgtactcagcaccaattccatgagctaagttcagggaccctgtctataccactacttggtttgcataaaagtgctgggatcccaaagtgctggaattacaggcgtgagccactctgcccagccccaaattcattctcatgagactttgcccagcctgtaagagggaagcctccatccccatgtagagataacctgatagcaatgctgagggaagcatattgatgtcctcctccatcagctatccagatcaggctgcaggcagctctgcagtggtggagcacaaggagactgcagaaggatccctagccttgggatcagtgccctggcttcaaagcccagccttgcctcttttaaattgctttcatatgtatctgcagctagtgtttcccaaacttcactcatcccagtacttcctttgcaaatatctgtgcatcacctgggcaatagctacttcatgatttccttcaagcactcacttttgtcccctaaattcattctaaaagaacagttcaaatggaaagtcagtatcttttgctataatagagggaatcataaaaagagagaagacaaaacaatattaataaattctagctaaattctgttatctgatgaagcttctgtctttctgttgactagagaaaatagcaaattttttttattttactttattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaactgtccccagagtgtgatgttccccttcctgtgtccgtgtgttctcattgttcaattcccacctatgagtgagaatatgcagtgtttggttttttgttcttgcgatagtttaccgagaatgatgattttacatttgcacttattagaaggactaaaagagagcttgaaactaaataactcacttcttggttcaaggctgttgagtactcaggctatgagccacccaaattacccccattctagtctacaccctacagtttaggaaaccccaggctagtgacatggaactacaaggctgagtttgtctgctcttgttgatgttattttgctttcatttttcccatctcaggtagaacagcagcattttgaatctttctctaccatgtactcagcaccaattccatgagctgctaagtttagggactctgtctacaccagcacttggtttgtgtaaaaggcaatatacagatccagcttgaactgagagcaaggaaaggccattagctatcctctgttctcagttattccttcctttcatttattcagaagcattctggagagaaatatatatatatatatattcaaaacacatgttttttcaaaatatgtttcaaaataaagctatgtgaaaaactcagaaatctcatatcacgtgagattcatttaaaaataggtgctaaaaattccaatgacactttccttcatgcaaaatattccattccctcaccagtcatctagcattcaccaatcaggtaatacttcggagaaaaaaaaatagatttatagcttcattttacagacagaatgactcaaactccaaagaggtaaagatagtcacccaatcacagagcatcatcttgaattaaaaaataatctaaacttaccgctctattttacacatgggctaactcacagtccaaagaggtgatgaagatggctgcccaagaccacatacaagaggtgacaatttaaaaattccatactctccaagtttatgcttttgagtcaaacagtagattggccagagtcacttctctcacgtgcaaacaccagaaaaactgctttatctgccaatatcaccattaaatattatgtccctcaaattcttcatgaaattcatggcaacctgtctgagttagcttatcccaaaggtctttatttttgtttggtttgattttccgaggccctatctgaacaaaggttgtaaatcaaaaggaaaaggcttggatggacttcctgaacattttgtaggatgcttgtcctttcaatgttctgtatttcttggccttagcatctccaacactaggttcattgtatcacacaacagtgtcaacaaatgctatgcactaaaggaaaaaagcaatggacctatcatctgctttctatcccatgtaacttcctaatcaatctttccctgtgataacctggggactgagaatacatttaaagcaacactgaatcctgtgaacattgccctttctccaaaggcatttttttttttaatcacaaaacaggaagttccaagccattgaaactcaccagtatatttgcttgaaagtcttctggaacaacaaaacggtacatgcctatccaggcaagcagactattataaaagcagatgttttgctcacttccacttcagagaaacacattgtcaatttagttaacatcctctagtcatttgaacagccttctcaggaagtcagcaatgatataactcaagtacaatatgatccttgtgttcccatttatctcatacttacacatcttagcagaagatagatgtgtgcgtgtgtgtgttaaatgaattagaaggaagaaaaatgctgggctactcactagtctcactaaaacatcaacccacaggagtgggattcaaagaacaaaaggttcttggagggtgtgggcatcactatacatggataacattcttgccaaggatctagcactgcctgtttcccacagccagcacagaataattcacccacacacacactctgtgtcgatcaaccactggaaaggtggtctccaagcatcccagcactcaatgtcagggacctcagccccttgtgcagtgatctggtctcatcgtgccttgggtaaagtggccatgcttcgtcagccagctcaagaagagaggctaaggttgggggtcaagatgaagggaaaactaagaaacagcctaagacaagcaaagggtgaagtgtcagggaggaaacaaagtaagacagaaaaaggaaaaagaaagagagaggtaaacagtagtgaccctggcaaaaaaaaaaaaaaaacaaaaaacaaacaggcgacaggcagcaggggaggagttgttgagaaacggcatggcttgtgtccacaccacagccctgctgttagagaactcatcccacagaatggggccattcagtgtgacagaacaggactgccagccacagtgcagggacagcaggagcaagagcactgagatgctcctgaaccattatcacagaaggagaggaaaactgcattaatgactgaactaactttaggtcttttcaaaacaaatatagtcatcaagctaaatattcccaagtctccagaacacacatgggtatgcacaaacatgtgtgcacaaacacacacacacacacacacacacacacctctttgctggcaacaagataagcaagtattagccagcattattgggacaggttttagccctaatttacagagcttttgagatcatgccccagtaaatttttttaagctaatgtgttcatacaggagcatcacaagtaagtttatccaagtcactgttaaacccacaccctgtcttactaactcagaccatctatttcaatagctaatctctctcacttgaggatgttagccaaggcttgttggtaagggtgaagaggggcaaatagcagagggcagaagggccccagctccagtcaacctttttctctctctcaaacatcaatgccacccaagtagcaccagaatcacaaggcatccagacatcagtgggatttgaacaaagggccaaagttctctttttcaaatgtctgcttggggccttgcaaagccagaatttaaccttatgctactggggtaatgttcatttgggagcacttaaacttaaattactcttaaatcactcctctgtactagacacacccagctcttggcagtgaaccagagtctagatgcaccgcccacaacccactgttcaaacctgaaacttgaaaggcctcaaaatccaaaaagtaaacacggcttcttaatcacttttttaaatcatcagcttcctttatctccagcaccttgtttttctgttgggtcgttccaagcagaagcgagaagtgaaatgctaggccaggatgggtgtatggaggaccacagtgttctgggtgctgcagcagacactacagagggcacagaagaggctcatgcagttcagcccttgtggcgctgccagggcattgtccggggaagggggtcagagcacagcatcaagccaggccgctgctctacctttatgaatggtgtgactttggggaagttactgaacctctgcccctttgttttctcatctataaaacaaggatgatagcaatgtctaactcataggactattgcaaaaattaaatgagttaatatatttaagagcttagaacagtgcctatgagctttattattatcatcatcattattaccattattattccttagtttataagccatggatcacttcccattgcctaccgaggtaaatacacacaccctgatgtagcattccaggttggaactatcttctccaacctacatttttagcctcatctcccattgctatctgccatgcaccatgcacttaaaacaaaggaggtggttctccccatttcctggacatatctcataattctctgactcagctcacatagttttctctgcatttccacatttctatcaaaagtgaatccatctttcaagaccattctcaaatgctgcttgaatttccaaatattcattgaacatgtaaaatcctatagtttctcacaggatgtggctgcatgtactctggctgtcagtgtgcttcttcaaaggtaacaaccaatattgggtgaactacactggatatgctctaaataatctagagtataaagggaaggatcattttcataattaatttatttctttattgcactaatataatgccagatttttagaagccacatgatcacagcttctgttccactagttattcttcacctaaatcttctgtcgagccttcccataattatgcaattaattttttaaacctaaatgcacaattttacatttgtatctactgagagacaccttgcagatcaccaggcagagctccaacttgaaaaagtaatgtggataatactttgttatcttttatattggccatataccccggtgaagtcatctaaaaagcttgagagcattctgtctgcatcatagataccaatgtgaaataatgtaggatgaggacagattattgcagccatccactagtctccccaatttgacagatccaagatctttagatatagttatttcaccagatgtctaactcaccctgccaattttcatcaccttatccacacagacatcaagaaattttataaaacactttcctaaaaccaagttttcactatctattcccttcccctagtaagaatcttttttaagactaaggggttaatttgcatgacaaacatgtttgtctcctagaaactaccactcttttctaatgctccaaaacaatgtctggatatatttttcatgtaatagaaaaaagaaataggagactgatggggaagattcacaattcagtgacaagaagcagcccagaaatctcaaccgcctgggatatttgttctaatgaatctaagggtcagatgaacttctaaatacaatgcagccactccttagcagtttataactgccaagtaggagcgtacacctcctggaacctttagactttcgaaggttcgtaatcctgtcccccagttgaccattatatcaggtgagccatgcagcagactaggaagagttaagatctcttgggttcagtttcctgatattttagagaatcttaagttacaacaattctacattcccgaattgggacatccgtccacgagaaaggcatttccccactcccaccatgatctagagcaaacacgaacaacctctgaataaagcaaagagtcttgtgtgagcaaacctagcctaacactctagactgtgatctgttcatttctaaatagactacaatacctagtctctgaaaatgccaccctatccacctgtaagtcccagtattcgtgcccttgtgtagtctcctcttctcaaatctgggttggccctgggactcgcatttgacctatagaatatagcagaagcaacacagcatgactccaatgttaggtcataaaaagccttgcagcttagaatgctccctccagcaacccagccactgtgctgttagaagccatatgcaaacattgatgtcctcaagaacctcaactgaactctgacagccagtagcaagcagccattcgattgagccactcgaacatccagcttagtggtcttctaatgactgcagccccaggccaacatttgaccacagccacatgagaccgcaaatgagaccacccagatgaactcagtcaacacctagaactacaaaaagtaataataaactgttgtttcaagccattaagtttagggttgatttgttacacagaaatatctggaatcagacccaacttggagactgtggatagcagaatctacttttattctaggcctggaaatgccaaagatgactctggggtcccaggaacttacagccaagttgtcccgggcctcagatatttgaggcctatggatgactcaaaactctgaaataaagatcaaccagaagaactgagctctctggcactgtgtcctaattcggactgttggagaatatcacacaacagtaaaatcttacgtaactgcaaattcactcaagtggaatttcaactaatcacaaattcattatatgtgatctttaagttttcaaagtttgaaataatttatttaacttctagcatcaaaattggattgaaagagctactcttcaaattaaaaatcaatagatgtttataatcatgggctcataaaatattgaaaacaccattcattccatattattccacacacagtgcaaggtaatgagtatgcaactggggtcaaaggagacataacctttgagcaagcaatccagcatgaaaggtaaactctataaagtaaacaaacaaatgattaaaacttcaacatggaatgcagtaataaagaagcaatggtagaggaaattctcatcaaggatgtctctctggagaagaaatatttcatctgacacctgaaggatgaaaaaagttcccaaagtactttatacaagttgcaaggcttgataattaaaattcttatgtagtagataattgtagtgaactgtattttttctccattgacttgcctacacactcagagcactttaaagtcttcccctagcattagtactacatttcaaattttgaatttcataaaaccacctccctcctaactactcaccttcctctcactcttctgcactgtcttgttccccaagacctccccaatgtggacttcatcccagttctgcatgtggcccctttgtgtgaccctcatgaacacattctccaggtttatccccagcagtcctcctacacatgactgacagtattagccccctgctaccatgcaccatgaccctgagaagaagcaccctacctcacatcccacctgacccttagccctcacctgcttttccagagagaggaacttgacgtcttacaagtaatcatgtatttactagtatataattttctgaaattattttcaagtaatacatggacttttgatcttattggtcagtctaataggcaatggagggctcacacatctgcttcagcacaaatcaaggcctgcctgacattaagacctggcttcctggtgtggttgacatggttagttgcctccccaatattcactccatttatctcccttttgtgctgcgtgggtgggattaacatccgtggcagagtcagttggctgatcagcaaagattcatgccgccttccacaggttggagtggatgctggaaagcagatgcccactcaaggcatcttctcacactttacacttttcttgacctaggaggggtcacatgattagttctcaccagtggaatttgaggggatgtgatgtgtgtcatttctgagctaaagtagttgagaagtagatgtatcttctccaaggtctctttctctgtttgcagcaattttggagtgccacgttgaagatggaagagtgctaagatactgaataagctcctggaggtgaaccaatcattaggattagcaacacccatatcagtctacgagataactaaaaaataaatgtttacttaataaatgtattaatccagagagaagttgggatttacctgttatagcacctagctctcccatattaatatggcattattccaagctccagcgatggattcagacttggttcagagatgggcatgtatcccacgtctgagccaatcagtgcatagtgttcctctagccacagaagtgtcttcaaaagctgacatattgcctaactcagtccaattagaagaaagattatgatttcttttcaaagttttggagaaaataagctttgtctttcctactgaatatgaataacaaagtatatagtgaagcattttgtgatagtctgaagccaacacacaagaaagaagggccaagagaaacattaagaataatagaaccagagtcttgatcaaactgtgcctgggcatgtaatctattagatttttctgtttcctaagctaatacattcccttaatttttaagccagtttaaatttggttttctttattaataactaatatcttccaagtatatacttcattatacatgaaactcttgtaatcagtatagggaaaaggaataaattaaaaccaattgcaatttaaacataattcacagttcacaaaaccccaagtattaagataggatatataattggcacatcaataaaacattaatcaaaattcataagtatctatacctatgacatgcactatatcagtcagaataggttaagttatgcttccataataactaactccaaaatctcagtgagttatgaaaagtttatttcttgctaatgctatgctatgtgtcccattctgggccacctgtgcctcatcttcatcattcctctgggccttagactgctaaaataagcctctatctggaacaggaaaaagacacaacacagtgaaccacatggtgaatcttaaaaacttctgttgcgtgtattggtcagagcaaacctggagtcacagagataattctttataagagacgtagtgaatatttgatttgagcaatattaagatattttattaaaatttttaattcaaaaaaaattaatattttatatgaacagtagatttctaaagttgataaatcctaaattacctactgaaagaataattaagaccctaaagaataatcaggcccaaccttaccatttgtcagcccacagatcagaatgtgaaaataagttcatccaaggttgaaagaagttgggctgtcaataaaaaagtgttgaaaagtcttctccaaaacattgtctgtcaccattctaaaattttaatgactactactaaggtgctggtcagaagagagaaacactagaaaaaatattgacactttaatggaatttgaggagaaacctacttgtaggagtctgtccatctgtgctattctaatattttattttactactaaggcttctcttctgtaaggggtggtggtaacagtagcagctttacagaggtcatagaactgaagaaaaggattttactgagaatttcaaagtgctaagcacagtacaaatatgacgtcatggaaacatcaccacacccttatgaagtcggtggtctcatctccgtgttatagaggtgatgtcaatgtccaaggtctcagagctacgaagtagtagacacagatttaaacatgtgctctgcccctaaatcctatgcctcccataaatcaaggtttgccagaaagagagacaggctctgaactcaacaaaattatgaggaggtgattccaaggttatgtcaccctcccttgtccaatcagtgcatgcctttgtgaagaaatcagatattctgggggataagggtcaatgcattctcccacagagggcatgaagcctttggccacccacctgaagccccaccagtgacactctagatctccataggcaggaagaggcagcactgggagggcagaagtcttttcacattgccacctgtcatgctaagggccaccctaagattggagttcaggcaaacaggatggtggcagaaaatggaaagaaatctgtttggtgatcaagaaagcttcatttggtgaaaaacccagaacagagcaagattaaggaatcaggaggccaggtgctgaggtataaaggaatagactggaggcacagcagtgagaagtaggaaagcacttggagttacctcaggacaggatcggctgaagaaaaattagtcagtatactgactgttctctatttgcatagccacacatctgggtaggtcagcgcttctgtgactttaaccccactgagccaactccttactgataagcctgcaccctctgatggctctggcttctgtgcaatggagagatttgacgctattcattgagggtttcactacgtatctgtggccagttttttattttccttgcaaattgttatttgtaatatatctataacctgcaagtatggggcattatcataagtgttctattcaaagaagctagaggaccacgtgggctaattcaataccaatataaatgccattttttagttaacaaagcattctccaatgtattagctcatttgaacctcacgctaattctgtgaagtaaatattctcattcccgctttacagatgagaaaactgaggttggggtctattaactatctgtccaaagtctcaaagccagtggcagagatagaatttgaatttgggtcttctgacaatatgatattgccctaaggaaaggaattcataaatcagagagaacaattgtgggcactggcaaagaggaatgcattggaatggagaagaaggtccatatgacagctgtaagattatttcaaggagaaatgaagacaaattggaattaagctctcttttaatgatacatttaccagtgatctgtcattgagaaagaactaatacatagagtatcaattttcagtaaatataaatggcaaataaggcatttaatgaattgcaaatgacagtgtttctaagagtagttatcaatcactagtaaaggccttcccatttattaatcatatatttcatttcagcaaagaatctaacaaaatggcataaagagaatacagagctgtgcaacacttgcagggaattaaaaagagaaagaatacagagatggtgcagatggtgactggggaaggtaggcatgaaaaacaaaacttctgctttatccatttcaaatgtgaagggaagacaagagagaaggaaaatatttagaaatgggattttaaaatagtcgggtaactgataaaacattaagaaaactacaaattgtgagccgagatcgcgccactgccctccagcccgggcaacagagcgagactccatctcaaaaaaaaaaaaaaaagaaaagaaaactgcaaattcatccactgtagggtaggttcttaagccaactaacaacaaaaaaaaaaagtgaaaaggaaagaatcttggccaaaagtaaagagcagttcagagaagataaaagagcaaaaatctgactgctcggagagtcaccatggttatggagagggctccagtacactgagttgccaaattatctcggagattgagcttatcaattcacacagcttcaggtatttagcctggccagagttttattcaaaacaaaggttaattaaaaaaaaaaaatagaaagtactctcatgctcccttcccctacttcatcctgccaacctatcaaaaaaaaaaaatcagtaagtctccttggccaactgaatgattttaatatcattataaagtcttaatagtttgttctggatgtgctagtaaagccaccatgcaaaggatttaaggcagcgtgaaattatcaggagaatgaaaacccagtagcatctcccaaagctattatagaaggcatggttcaagaaaggaatatccccaatcacaaaagaggaaaagagagtcagggctgcaaaggagagcaaaaaatatctacaaatggttactgcaactggtcaattaaatttagcctttcttctagtgtttaaattaccaaatcattttacacatttatacaagggcagaaatgtttgcaacaaactctgaagcaaaccagattgtcatttttttctcagggagcctaataattcaactcctcattcaaataacattgcatatttatgaggctggagtctaattaaattacatcagtcatcaatctgattttgctaaattttcttttcacataactattaatggaaatatgtgaacccccaaatatgagcctttaaatattgagttattagcactgtgttttctaaagaaaccctcttacaggtaccccaaatgtgctgcaccttgcacatcccctttctgctgcacatctgtttttcttccacattctttcttctgccatcccgtatcccaccctaccactcccagaatccaaatggcagaaaagtgtgaatgagcacaaaccaatcttgttattactaccatttccttctgcttactctcaaaataagtttcataagagagaattaggtcacttataaaattacaaaaagagtccttcatccaaaatcattcaccaagtggaagcttcaaaaacattaactgagggcatcatgacaactctggcctgaccttgggccttcatctccactgggttcagaatattgggtctaacttttagaatacagcttcctattttatctcaatggtatgtaaacactctatagcagaaactattttatttaacacagtgaaaatgaaatgaataatttctgtgtagtgaaaaagatgtctctcaactagagatactcaactctcataaaacaagtcacaaaactgcctctgatagcaacaaatgtatgcagtctagcagctaagaaataggtaagccagcattctcttaccagtttcaccccctcgtacgcattgcctagaaaaacttaccctcatcttccttatttcaagcctcaactgtagaatagaatcattctattttctttagtttatcatatagtatgctacaaaactcctcttgcaccataacttataatcctcttaaaatacatagattatctcaaatagttatgattctgaagccccactcctgaggctagaaaattctactcttggttcagttcctcgcattttattttatttatttgtttatttatttatttatttatttatttatttatttattgagacagggtctcactctgtcgcccaggctggagggcagtggtacaatcttggctcactgcaacctccggctcctggattcaagcgattctctttcctcagcctcctgagtagctggaattacaggcacatgacaccacgcctggctaatttttgtatttttagtagagacagagttttgccatgttggccaggctggtctcaaactcctgaccccaggtgatccacctgcctctccctcccaaagtgctgggattataggggtgagccaccacacccggcccctaccattttatattttatattcatcttacactggcagtataattttaaaactcaaaattctcataaaaacctggctttaatctctcttttcaacaattgaaccatcatattcctttacagttggttcaaaggaaattctaaaaattataaaactcaagtgatcattttgggggaacaaaacaaaggggcaattagattaaacagcattgaaataaactgcaaaatccaaatgaaatctctcagaggtttgtgcaaaattattaatagttttgaaacaagcagttaaaactaaactgaaggagtgtgggcccttcaggtgtccaaagttatacacctgcacacattttataaatacacactcatgcctctttactgacttagtcctctctttgagtaaagccattcttcttcggcataagtacacacaaatgactgtgtttctcaacaggggctgtttctgtgtccgtcccactgatctcaactaaacctccggaaccattaggaacacagaccaaatgtacactcaggtgcaactgaacatacctaggctgtccaacaacaacaaatgagattatttaatgaattttcatgtatatggaagtctgtgactgatagcattgattaaaaccaaccaagcataagggctactggcgttcaacatctaaacttcctaaaatatagcccgatcccaccctaaaacctaatatcctgctttttaacatttctgagtagacagatgtattttttttttctggtttccctgcacaccttctgtagaattcccattgcttcctttgcatgggaaggttggcagaaacatttatgtctggaattctagaaaaccaaaagacaaaagtggctagcaatagtaaagtcctccctcataaaacagctgctgattctggggtttttttctattgtttaccttgttgtttaatctgaagaaacattattgtctccttagaaatggccaccagatcaaaatggtcaaaaagatatcagagcttctggattctccacaaacatccactctctttgatgaagtttccccaccaatggtctttcacaattgaaaatctctcatctattgcggctacaaaggccagaaatcataggcagaaagcaagatcattatctagtttaaagacaaccctatgcctgtaaaaactgaaaggaagccctatatgaaaatatatataatgctggaagtagcccccaattgtagcatttggaaatagccctgctatctccctattgtttaatcaaaatgacctcctgcttcccagtttctcatgtctgggactcacattgctctccactacctgagtcccatccccaaagactctgatttaattggattggggttagtatttttaagcattccaagtgattctatgcagccatatttgaaagtcactgtctcttctcttaacttgtccactgctctttccctaaaagtaaaaaaagaatgatggcttccagcttcatccatgtccctacaaaggacatgaactcatccttttttatggctgcatagtattccatggtgtatatgtaccacattttcttaatccagtctatcactgatggacatttgggttggttccaagtctttgctattgtgaatagtgccgcaataaacatacgtgtgcatgtgccaaacaccgcatgttctcactcataggtgtgaattgaacaatgagaacacttggacacaggaaggggaacatcacacaccggggcctgtcatggggtggggggagggggagggggagggatagcattaggagacatacctaatgtaaatgacgagttaaagggtgcagcacaccaacatggccgatgtatacatatgtaacaaaactgcacgttgtgcacaggtaccctagaacttaaagtataataaataaataaataataaaaaattaaaaaagaactagatctgagagctcattaggctttccttatctaaattctacaggttattcaattaagtagctagtgaaatactttgttgcaggcccaagtcatttggatattaaaacaaaattgaggataagtgaacgagacttggtctcaagtattgtacaaaaaaaaaaaattagaaagttgtagctagctttccttgccctaaaaatatgctggtgagcttgggcatatttactgtcacaatacattgtttaggaaatgaaaatctgaatctagcaccatctattcactggtaaatgataaggtataattagcttgtgatgtcaggcaatgaagtaatgacgtatccctaagtcattcattcaaccaagacatttggatctccctaaacaaaactaaaatcataacgtaatagaaaatcacaatgcagataacttgaggaagaaaatgaaagatgaagggatgaccagcccctgtcataaaaagaagctttctcattttaaattgcagcaaaattcctctttactaagagttgtatgaaatcatttctttaagttaaagtgtcttttttccaaaatcttattacgttttatgagctttggaatgcccaggcaatgtagtgttctacttttatttctggatttaaaaaaataaggcagtggagcattcattcagattaagttcttcgactttattgtaaagcagatcaaggtttggatcctggctctgtacttaaagctgagaggcctggagcaaagaacaaacatgtctccagagcgctcatctctaagctaagacaataatatcatccacctcatagagatgtgaggattaactgcagtgacgcatgaacactcaacaaccttgactggcgttattacttattgttgctgttataaattatctccattttacagatgatgacattcaggcacagagaagtaaatagctggccaatgcccacacagctaggtagtgatagaaccaagccatctaatttaaaatatgctttgaaaaatgttaactagagtaatgccctcatggaacaacctgtaaacatccacaccaaaaaaaaatatgcatctggaacaaatattgtgctctaagggattaaaactgaaaaacctaaataatgtggttccagagtctacattcttaataccctcttagcatttttaatattctataatttctagagtttctaataagaaattctgtgtgtgttaagtttacacagctttttgcagctgataaaagcttatacatatgtcatcttatgttagcattgctggtctggaagaagccaaacagaggtagttattgttcctctcttacgcttgaggacactgaggctcagagggttaatgccctgcagaaggataccatactgatgagtagcaaacttgagactcaaacccctacatcctgacgtcccagccagcattatccgccagaaaacatgtttacggtacccaaaatatactgaagttttgagatgatcacgcctaagaaaaaaaacaagtccctatcttcaaggcagggagggctcaaaacaccacagagagcattttcctcttaggaaagttattagtaattaacaagcttcataatgacatgttatgacatggttaggtaaattactccagaagcagtagaaggaaacaaatgtcacattctacaagtcctggccaatgccaaggattcacttggaaggttaactaagatggagctcattatgctgtattaggtatcagagtattttgtcttcttgaagataaaaccttggtgactgatattaccataacttgagggcaggaagagagatctgatatacagaccatgaggcactttgaaaaccctagacatataatgctctttaccttgacatttcccatcctctaatgatccatctacccagtatttttaggtcaaaaaaatatatatgatacaatgctgcttcatgggtcaaaccacggtctctgctggtattttaatactgcatcattatcaacagaatacgtaaatcactcgcatcttaagcatttaggcaaatggggaattttgcttagaatttcagactgtgcccaaaagtaaagatgttcaatgcactgatttctgtgccaagcctagtggctggaacattggcttggatgcatacacatagctcagcaagatggttggcaaagacagttggaagagaaggcagcgctttttattcttatttctgtttcatgaacaagaaaatcacatgccagcctgaaagacaagccacttctgtgagtttatgtcaatttgggggtagcactatcttctactggataaaaattgaacctagcagaaagacacacctttggaaaccatggagacttcagtttgggcattttaatcagatctttgctctcagacagtggtgctcttgtaagtggcaagaagctggaggaatgagatcctttaaagagaacttgttcttgaactgtgatgggaaagtttgctctaactgcacaaaggataaaatacgcaaaaactgtgagcatggaaggagtaatttgcccatctgcagacccaaggcttgtatttctataaagtgtttatgggctatgtaaatacatcctacatcttactcagttattgcaatcagcatttccctaacaacagacaaatgtgataggcagactttccaggaaaacatcaggctgacacagtggctcactcctgtaatcccagcactttgggaggctgaggcttgcagatcatttgagcgcacaagttcgagaccagcctgggcaccatggtgaaaccctgtctcagctactccagaggctgaggcaagagaatcgcttgaacccaggaggcggaggttgcagtgagccaagatcacgccattgcactccagcctgggcggcaagagcgaaactccatctcaaaaaaaaaaaaaaaaaaaataggaaaacaaaatatctggagaagagacaggcttaggattcagtattccaagctcacaaaaccagtttgtagtcatggatatctttgtccctgttaataaatcattttcaggggtatatgtatgtctgtcaaatgtcggtgttcaatattttcaggaaattgagtgtttataggatttaattcatcatgccttacatatgctaggtacttgataactattcattaattcaatttgattgatctaacttaaaatatactttgaaaaatgttaatagagtaatgccctcatggaacaaccagtaaacatccacaccaaaaaagtacgcatttgaaacaaatattgtgctctaaggaattaaaattgcaaagtaaattaatcccttaaagatttatatgaataattttaattccttgaatggtaccttttcaaatccaatctaaaatgtccaatatgtttgcaatctgatataatccaatgagttttaataagcaaaatagttcttgccagtagaaccaaaacccagttattccatttttgtaaccttctgtgtaaaggaatgggctgaactaattttttctgaattttttatatttaatcaacaacatcattgccaaagaaaaccacttttcagaagtctctctatcctggtttataacttataatcaaaaactggaattttgcatctgatgggctttagtgtgtaacactatactgtcatattttttatgctatagttaaaagtaaaagatagtttccattataaaaattttcccatagtctgattacccagtgaaaaacatttttctataaaaatggtcttcataattcataagctagaaattattgtgggtaattttttaaagaacatcaaaaaagttttggtgggtctagtagcatcagttggctttaggtacatgtacaggataaggcagtatgataataatgtcccacacaaacaaggaaatcacttaacaacaacaaaaaagccttgaggcctgaaactctgacaacttacttatccttacccagtttgggctacatggattgatttcagctacagcctgttccaagcagcaggaagaaatagaaatggggcataatataagacctggaataatcctgtaagcttgaaatagcacagatatatcacagtggattttagaaagatataccttagctctggttttagacccttgatcctccagaagccaaagatgcttggaaatctgatctgccctgacagtgaagcaaccctctatgaccttcccaaaaccctgctgtgaccgtgtctcagaggccagcacacttcaccctgaactgtgagcttcctttaattgcagactttactttcatattcctttgggtcctggtttggggaacttctctgtctgttttgttctgaaaactggacactacccaaatgtcatccacagggaattggttcaatgaaatgtgttagatctaaacaatagaggatcttctgcctttaaaaagaatggtttagattgatacatacagacaaaaatccaaggtatattaagtttaaaaaaagaaaaagccctttatttctttctcttgtctgattgctctgactaggacttccagtactgtgttgaagaggagtggtgagagtgggcatcattgtcttgttccagtttgcagacggaatgctttcaacttttccccactcagtgttatgttggccatgggtttgtcacaataaaataatgcttttagtacattgaggtatgtcccttaaatgccaattttgctgaaagttttaatcctaaagggatgctggattttgtcaaatgccttttctgcatctattgagatgatcatgtgatttttgtttttaattctgtttatgtagtgtatcatatttattgacttgtgtatattaaaccatccctgcaagtgatatgaaacccacttgatcatggtggattatctttttgataagttgttgaatttggttagctactatgttgttaaggattttagcatctatgttcatcaggatattggtctgtagttttcttttttggttacggcatttgcagcgacctggatgagattggagactattattctaagtgaagtaactcaggaatggaaaaccaaacattgatgttctcgctgatatatgggagctaagctatggggatgcaaaggcataagaatgatacaatggacttggggggaagggtggagagaggatgagggataagactacaaatatggtgcggtgtatactgctcagatgatgggtgcaccaaaatctcacaaatcaccactaaaaaatttactcatgtaaccaaatatcactagtaccccagtaacctacgaagaagaaaaaaaagaaaaggcaatttgctgtaaaaagttgtaaatctatatgtatgtatgtgctaatatatgcatgggggaaaaaatctgctggaagctacactaaaggatgaatggtggtcatctgcaggcaatttatgacaaaaaagaaagaaaataactttcatttttattttatacattcttttcatttaaaaattattgtgtataaattttgtaacaagaaaaatattgtgtataagacaatgaaaaaagattgataaaaactttaagatgttttataataaacatgctaaggtgaatcaagtctgaaaaaatggttgaacccccattcaaccatttagaaatttagaaatccatgagctgctaaaattgtatgaaaatgtttcttgcatgtgtattttctggaaagaagctccatactttctatgagattctcacaggagtctgggacccaaaagaaggtcatgaactatgaccctagccaaaactaagatagctattccatccctccattcgtttttattatcattttatcatgaaacattttattactaatttcatagttcccaccaaaggtaaagtctatgctaagcataaaagctgtgggtcttagtcttaccctcacttagaggagttcccattgacttaggagcagtcctaagtgcacaagaaaccatatatggctgttctcggtaaaagaaaactcctaacaggcactaaaagcctgtaatcattcaggacttgaggatagttgtccaagacacagacagtcctattttctctatagagatggttgatttgtgaaatgacagatgggggttagaggagtggggaggggcagagaagaagaagtcatgtttgcacttgaattaagggaacagagttgagtgagttgggttaatttaatcagtaaaacaagattcaatacattatctatcaaccttaaattgtttgaaagaaatctttaatcataaaagtgcatttaaatatacagcaaaatgcttgacaccatgctctatattaatagagcataaatattaggcagcaaaactgcctacattggtgttaggatttaggtaaaaacttggcttctgatgacttgtaaactgaatattcccaaatccctaggaattacatgagtccacagaatgttttaccatttctaccttgactcctttgacattctccagaatcaggtctagtacagagtttaagatcaataacaatttgtgatttaagtgaggggtcatgggcaatacctgcactggcaaaatgagggacattattggtgaaaattaggaataatactccactttccaggtggtttatcactgtcaaaataggtcaattgtggatttagtatgcacttgaaatgtcagatatcccagaattctggtgccgacattacttaactgcacaggttttacagccaaagaaattgaaggggttcacataatccaccaaagcccattgctaaccaccatcacctaatcatattgatatctgccatatgcaaagcatagtattaggccctatacaaaacagaaatgggctctccaggagttttacagtttacctagaaaaataagatatataccatgaagacaagcaatttataataaaatgccaaaatgatgataaagacaattccatactattggaatgaaataacatagaagtcatatctccaggagagatcatgaagaagcaggagttcaaatgaaatcttagaggagttagattttgacagtcagtgtacagtatgggtagatttacaaactatggcaacattatggccaaaatttggatggtagaaacacaagagtaggctgataagagactgagaggtacagaatgagtaaacaaggtaggctgaatggaccagtcttgaataagacaagcctgaaaagtcaataaaataatgtattgaactcttattctatttaaggcactctaaatgcattagtttgatcaaatcctcacatgaggtaagtacctctagtccacaagtaaggaaactgaggcacaaaaaggttacatggcttgccttcatttcaaccagctagtaaatggtggagccaggattcaaacccaggcaaatctcactcccgacctgtactcaggagtcaccacattcttctggcacaaaagtagagcccctcaacagccaagctaaggaatttgagattcagcatcaggtataaagattgagaatgaggtgataactcattgataatgcttatatgcatggttcatcactactcagaatcttcctctaaaagaattgcattatccgatgatattcccaacaatattcactgatagtgatatgtattcactgacaagtcccatgactacagtattgagttagatattataaagtgctcagtcaaatctttatcaggagagtccattgtgttgacattccatcaccacaatttttaatcctaaagacttaattttacctgttattcacctaacacttctgctagaaatacaactcatgataataaacagagcaaagtatgtttattttcacatgttacccgaacatatatgaccttcctacatggaaagccactctgctcaaataagacgttcatcccttaaaaacttatttctccatcctaggttcaggtcttaaaaatcagttgggttcctcagttacagatgtacaggacattacatctggactctcctaggagggcaggggtgaactcttcctctgaatatccacagtagccaaatgactccttctcccactgtggaaaaccacagatgactgtctcctaatgatttactgcccaacccccagcccacaaatcaaagaattgggtttagtgagaaataagaaagaatggtggccagtggatacaagaaggggagggaatgcttcagtttattttcttaagccaattaatgatgaaacggcatggagggaaagaaagacacaacatagttgtaaaagactatttttccagataaatggccagatatcagattctgtaataagtacttccacctatcaaaacacacacacacacacacacacacacacatattaacttgaggtggggaagaagatatagatcttaaaaacacaaggtaatattcaaaaaccattctggatatcaccataaaatgaaactttgaagcacccttggaaatcaatgaatctggacattgcaaaccctacaaactatatattgcaggcagaggtgtttggttgggcctgcagaattttttaaaattgaatcaacatttcataaagtagagaaaacttacataaaaacccagatttgtggcttctcttaaaaagtggaagacctggcggccctgaacccccttgcccaaatggtaacagtgagcaggagctgagaagaagctgccacctttagaggagtcttgaactgccagtttcccaccatccccgccactccctcttgttctgaaatacaaaggctgggtgtcaaaaaattaaataaaaataggagagagcttaaggcttatacccaccttgcttcactcatttatggtacctgcaaatttacaggctctgctctagtctaatccattcatttaaagaggagcaacccagctgcagtagtaaagtgacttacaaactcaatccactaaaagtcaaattttcattcaggagggattattgcctaatgataactagagagtatgcaaaactaaattagggctgtgtggctatacaatgccaaaatctgtggggaaaagttgaaatctcaatcattttatttacacatccccctcaccccgactccaaataaagggcaaaggaagatgctcaagttttcagaacaaatttactgcctagtttggcttggtatggacagttttaatgtgcccaaattttagatatgacttcccttcattctgagggcataatttattgagaagacatacaaaatgcttaccgtagacatgtaaatacttttaaaaaggaaactggataaaaacattaaacaggaggggaaaaaaaaggatgtttcttcttcagaaaatttaactgataaattataaggaaactgaaacccactaagatttattgagcatgtgccttaggtactttgcacacattataccaattaactctcacagcagcccaaggagggtagtattattactcccacttcacaagtaaagatgctaggcctcagaggcattcaataacttgaagaggacctgacttttcaatcagggatcatgcccagattcaaacactgatgtgcacgtttgtaatgcttgtgagagtagggaacatggtttgcccgtgcacagggcctagcacattgatatttgttgtgtaagcctgcccatcgccaaagcacaaaaactgccatgtacaagcactttcattcataaatgtcatcatttgaacaaccttgacatatacaactaattcatttaggcaggttcttgaacaaggtttaggaaatgttggttctttatgttgtgtagttaatgacccctacacacatgtttactaacataataaaatctcttttctaaataaatttctcctttagaattgttataaaagtcagtagtcaagaatttggctgaatatacaagccaaaagcacgtttgctaatgaataagaataataactaaaatcaaaataagaattaattcaagaatgagtgcttttgaagagtcaggaatttgattaaaaattcagttccctttttttccataatgaaacagttctttaaccacaaaacagcttttataataatgccgaagagtatggttccaagcaaaacactcccccattttaatcatggctattatttttgaaaatgaaaatgactgaggtcattgtaatctattttagggtttgcatgggttgatggtatttttgtcttggctttgagttctccacattacccactaaatgttatgggctttaccgtgtgccctttcaaatcccattctttctaataacattgtattttatacacataaattagagtaaattccactttctttcctaacaactccagatgtggtccacactttcaaaaggactagaacttgccttaaaaaaaattcagtatgtacttcttagaacaactatgtttctatatagataaaaatgctgtatggatgtttaaatgctgaataattagtaaaaccataggacttgtggttttttcaccaaagtgaaatatgaagataatatctatatatttactccttccaacttacaaggacatacacagataaaaaatgcctagaaacaaaaccatctgggcagagttctagacctactgataccaatagggaagggggatctgtattcagacaaccatttagaacacatcagtgaggctctctgtcccctgtagacccagtagacaaaattaacaaatatctaaatacactaaagttacacagtcaaggctccctttagacgcagttaatatttcacttactttctgaacttagttggggtttttattaaaattcgctatcacgatccctctaggtaacccctacacagccacacgtgagagaatggcttcacaatacatacaaattgtggagatctggctattaaaatgccttgagatctgtttgtttatttttttaaaatcaacttgcaaggccaatgtaataagatgctgtagcttttatgaaagaggtgaaataattttaaacacagacacacaatgagtttatttatttagaaacttgttaaatagagtctgggaattcaaatattcaatgttgacattgtacagaattggcaagaagccagaacccagtctccagagggacccattggacaaggaattcaggactttctctcctcccacttgagctaaataggtagaagccattagttatacccacagcaatatctgaaccacactcaaataagctgccccagccagggcacttcaaaggaggctaagtgtgtttagctttttagtgctgaactagagcaatatgtcacacttttgaaagagtcttgtaaacagtttcttccctatgtagagacatctctgaagtttcttgtatggcttgtagtaagcaaaggtaattaacaaggattatacttttttcatttcctggaggggctggggaggataataccaatctgtgtgcaaactaaggatctggaagaactacactatttctcccttcctgtctccctctctggttttctgatcgatttgtctgtctcctctttatcctcttccttacacttgttctcactatacagccaatttccttgaaaattccctggtaaactctgaaggccagaagagtgggaagggggaaatctaattttagaaagaagaccgtggctagtggagtggggaagtcgggagggaactaatgatttatcctgcgccgtccaggagaaaagaaaagcagaccccacagaccgttttagaaaatgcctagacagcggcttccagcggaagaagggttaaccgtcactccaaaaaaatgtacctggcatcatcagagtgtaacttttccctcccaccccatctcttccccaaactcactctcccttgccctatgaggctaggaaggagcctgtcccaacagggagagtgaatgagtgagtgtgtgcctgccctccgcgcaagagtgctccttgtcttcctgaagccaagacgtgtgtgggtgtgcacacgcatgtgtgggtgtgagtttacactgtcaatgtaaacccagctccgagggaagcagcgcgccaggcacgcagcccctctgagactagagagggaaagaagagttctggccaaaccttggagccctgagctgagcagcctgaggagcgaggtgtagggggccccctgagtgagaaactgcctcccacctcactggggcttccccagtcccacccccacgtccatcttgggccacttcctcagcaccagacggttttgagatgaagcgtgggagggctcagctcttgggaacagggctctgggtgccttgggaacagggaaaaagccggtgaccaggagatgacaagtcaaggttctccatctcaccgcccgcttccagcggaggcaacgcgcaggggggtgccgggagagagggggccgagccgggcgtgccgggggcaactccgctctcttgtccttctagcccggggaggagggcgtccccccttcctgccccaggtcacaactgcagcctcggataacctggccccaacttacaaaaataaaataaactcccaaacagtaacatgcttaaagagaaattgcttacgactcctcaccttcaactccaaaaaaaaaaaaaaaaaaagaaagagaaagaaagaaagaaaccaaaattcgtggaatgacatgttaatttctagtcctacatgttgaatgtctgtccctgcaggaagccggccccagggcccaggggaggccttggctcagaaagcctgggagctgggctagccggcaaaagtcacactcactcacattcacacacacactcacatgcactctatagccaagacctgcaactctgcagtccctacaaataaaaaaagaagccttgctttttagcctttctgcctctacagctaatgaaccgttcccttccacagtgctggagatgagggaagaatgaaaagcgtaattaaccttcccctaaacacagatttttttttttttttttttttttttttttttttgcaaaacacatcaaaatactgcaagaagactgtgctccaagtgccaaatgcaataaagaagccctaagcccgggtaatggtcaagtaatagcaaataaaccgccttcctagaaggggcctcggcctccgttgggagaaggattttcctcctcagaagcaatctgaaataaacaaataaaagtattttttaaaacaaagctctgttttcatctgagtttcttaaggatgaaggaaaacccaagtaggtgggcatacagagagtaaatgcctgaatctgggtgttgtgtttgttgttgtgggggggttgttttgttgtgtttatctcagttactgggctgacaaggtgagtagtttaaggacgggagaaagggtcggcatctacctttcctacttcagagcctttttttaaacagagagcaagtgtaggagtaacaagtgccccccttgccgcggtcttgctaatcgcatcgccttttgagactttacgagacttctggggggccggtagctaagggagttactggatgcaactcgttctctgctgtgactgaattcccgcgcgttgtcactttggggaagtaaggtaagggtggcttcggtatttcaggctttagacatgctgcgcagacccaacctgcacttcctttccatccatcaggaccatagcaactggcatttctggcacggcccaggtgctgtcctagctgcccaagaaaacggctgggaagtctccccgcgctgccagagtcggtttggcttttggttttcttttcttaaagatggaaataaaattcaggggcgttaggcactacaaatgtcaatcttcctgcctttcattttatttttaattaaattttttaaccttcccaaatgatttacaacgaatttatcggtttcaactactgtataaaatacaagccttacaagttgcaaactgtgttgtgcattcaatctcggtgtagattcagtgggtattttcagggtccgtggtctctggtctaggtccatgggctcctgtactgtagtcaaggccaaatcaggacttaagaccaccaaagaaatttacaaaagacaaaaagaacaacaagctaccgagaaaacaactatttatatgtaatttgtttccattgtaatgttttctcttgccacaataaaggtagttttgttttttaaagtattgtagtcacaactccccttctaaacccagaaaaagaaaaactggtgcagagcagtgaagttttcgttggatgattgcaccgcaggggtcaccaaccatctccgccacgcgctactcgggggaaggaaatcgcgctttaaaatacaaaaatctgtagttttaatatgatttcctttattacccagattgtaactgaagaattgcaacgcagcgcttctgtctgggaaaggcagctgcggcagcaacagctggagtagtgcaagcgggaatctgaggctcagtaaaagtttgtaagagttgagatctagctatcagaaagcggcagcggcatccttagagaccctggggacaaaataaatgggtctcccaccagttgaatgacaagtatcatcagatcggaaacgaggctcagtttctggatgctgagtggactgtgcgtgcgggaatattttaagacggcatcgtatgtcttgcttggcaattaaaatagttgaaaaagttgctcaagaaaattcgaagggttttgtgttctgctttcacttcagaagttatcgggcagtgagttgcggcgcgaagccttaagctttcacttcacaacttaggcatggttgaaaagggctacccacccccacccaccatcccactcccgccaactcccccccccacacacacactctctctctctcccaacctttagtccaaatcgaagcccgcaaacctcaagtatatgtacatttatttcccttcagatgaaaataaagacatcggcctcatttaaaagcaaacagggaaaacagttccaccggcgccctttgacactgtagcagcgagtgtaaagaacaacacccaaaagagaaacagatggactgatgacccaaagagccctatatttaggttgatttctcagacccaggggaaaggaaatgtatcggggagtgtacgagtgcttgggtgaggactgcacaaagcactggaaaggcgcctgggatgacagcatctcgcggggctacaccgccgactccaatgcccgcgaagccgagcctgctgaggtgccgccgacttcccgggctgctgcagggacgcagtgagcaaggaggcgtggatacgatacctaccgtatttggttctaatgtgcgagggtcgcgcggggggagactgggatttcactggggagaagcatcccacccatctccgatctctcatttctgcgttccgtaaacaacacaattagagagttttgttttcggcgagtgcgagtgtgggagagagaaccgcggcctgtccactcccgaggcagctccagccccgcctattgacacctcaaggaagagcgctcccagccgctccggggctcagtgtccctgagtccccttcaactcgaagtagaagcatttggacaaacgcagtcctgtcgtctacagtcctggcggagcatcacaccgtgtgggaaagtgtgggccccgccggcaaagccaggcgagtcatccaacacttttgctgtaagagtgggggatgggactcccaccgccccctccccaaaccccttagcccacatcccgccagaccaaggccgctccgcgccgggcaggcagggggcgccggggagggttattgaccctggacccaggctgcacccagacgaagcgccggaggctgcgctgcgccctctccgcggcccaacgctctggcagcccgccccctggggtttgctcggcgcccagcaagcccgaggtgcgcgggtcgcagcgcgccctctctgcctcctgctcctaggctgccgccgctggctgtgtgccctccactcccggctctccgagcgctcgctgggcctcttctctccccacgtccgagcgctcgctgggcctctttcctccccacctgcgcgtggctgtgcggagccggtagctctgctctgcccgtgcccccgcccccaccccgcgatcacagcccccaccttggtgtcccctactccccgccgcagtcctcccgccgcgcagcgccgcgccggagagcatggccgagcgcacagcgcccactaccgcagccgcggctcggcgcagtccacccgcccgcccgcgcaacttccagcggccgcctcgcaacttttcccaagtccaccacagccgcccgccgccgccgccactgtggctccctctgagccgcctaccctacccaaaccccagaaacaaaccgaggctcgaaaaggctcccttctcctgccggccccccatcccccgcgcccccctcctcccacacccgggactagctggttggccagaggcaactctcccccgcctggggggaaggggaggggagggggagactttctcctcttctcttcccccccaccccaccccttcgcgctcactctcgcgctctctcctccctcccacccctagtctttgctgcccccacccccacccccaccccggggttgccacagctggtcggtgcgcgggactgagggctgcccaggctcctccggcgcccaacccgggagcgagagcgcgggcgaccgggagcagagactggaaccggcaggttgctggggctgcgctccgcctgccctccacccggggccccggcgcaagaggcagcccgcgctccctcccggagcgctagagacagatatgcaagatggcagaggagggggaaaagccaatagaaaagggatattgcacctacttgtggccagtttccttgccctgcctttggatctcatgctgtgcccagtcctgcagccgctggtgtgtggttggggcttttttttcttggatcctttccttcttttgctctccctctcgctccctccctctctctcctgtctctctctctctctctctctctctctctctctctctctctctctctctctctctccctccctcctgtttctctcctgtttctctctctcttccacacactcactctctgtattttcttctttcactctctctccctccctctctccctttctctcaatccacactcgctatctctccagcattgtcagtttggacaccttcgcacatgcgcgctagacgcccctccaacatctcagcgccgccaaaaaaagtttggagcgatttatcactttgatttggagatcttgtcagatggcaatcgccgaggaggcggagaaagggagccgcggggagggcggcggggggcggggagcgaacgcagggagccagaggggagcagacacctcgcccaaaaaaaggggaggggggaattgaaaaggcttgggcagaggattgattccatgttagaatcgccaacaagcttgtatcatgattattgttattgtttttcccaccataaattgcagacatttttctataccatctacgagggaagcaagaagccaggggggaaaaaaactttaaaaacattttttaaaaacccttctcctgttaaagaactagaagggctggaccctcggctaataatccaggagaaagtgagaatcatcctgaacttgagaaatctactgctgccgctgctactgctactgaagctattgcagcttccgctttcagggttgtaagcagaataaataactggttttttcctcgattttagctgtaataccaatgcttgctgccatccttgggacatttcagtattctttccctaccaagtagtaatgatcacccttgattcccgggtccgggccggcgctggcatttgacatccaaagacctcctgctttctcagaggtcggctgtcaccttccggcctcccccactgctgccccggtcgcctcccgatgcagctctgcttgcctgccattttcactcactcgcttaaacctacaacctcggggtcaaaagaaagaggagtagggaggaaaatcacacactcttaaaaaaatacattgttgaaatttcctttaattacaggatttaccaatgaagtgccactcagaaatgggaattcctaaaggggctagctgtgtacaaggtatgaatcaatcccaactaggtatagattttcttttggtacaaccttcttgcattaaacagttttgttcaataccttccatgtgctatttatgtccccattaatatctgttgcaaatcctgccagacaccataaaagaaaattacaatcttttcagtctccgtgctgcaacaatacatccttgatgttcaagttaaaggaaaagaaaagcaggtcctgggcatgagtttggcaaaggctgtggagggaaaggggaatcattgagaatgcccagtcgtacctgttggtatttattatcaaatctaggactgcagacatgagagagcaaataacaaggttcaaccccaaagggtatcaatggcctgcaaatctctttattcaagagaatcaaagttcaaagaatttgtccttgttaaggatgcctaccattttcctttatccagagctgtgtaattctgggggcatttggctgtaagatagaggtccctggagaaccaagctacaggtctcaagggagacagatgtataaggttgaaatgtgaggaagggaagtaggaaggtaaaggagggaattactcacaacaggagtaaaacaacttccaaaagagaaggctctagtgcccacacgcgtgggcacaagagaactctattatccactctgaattaaagaggcacctgggtttttttccagacctagaattcccgctgtcctgtgcataaaggtgagtgtgctaacacatttggtgtgtgcaaaagcaccagccattccaacattctgttaggttcacacaggtctttgactctgaaacttcccccaaaatgtgactccaccagcttccctcagtttagatggagaggtgcctaccctctgaccagcaaatgtcctccgaggaaacggagaaatgggtcttgagaggctttggaaggggggacaaaatctctagggagagacaaacactaggctgactggcaagaagttcataaggctgcttctgatcggtgtaagagactctctagggaccatcccctaggccaggggacagaccagcagcacctgaagatcccagctgtcaaaatctaggtcttgtccctccaatcctcaccttccctgccaggcaccccaggggtggctgagcaccttgccttggtgcccaaccgccaaggtagcttaaaaaaaaaaaagaaagagaagaaaagaaaaaagaaaagaaccgccatcctcccctccactcctccggctaatccctttcacctcatccccagggggtctgtctatgtctaggttcccttggagacgggaggttaagaggggtgcaagaaatgttcctaggaaaggaggggaccaaggtaccaaactctgagattaaatgcaagacccacatgtgaagctgagcttgctgttgctgctgagaaattataaaccacgtggagggttggggaggtagggggtgggttctgtgaggggaactgggtgggaggtggaagactgaagtgaatcggagtctccgaacctccaaatttaaaggtccccgtcttttaaacttttctagaaggggggttggcggagtgggaggcggaatgaggcgcggctggagtacccctccccttctggtttgaagtctccgctgtcgcttcagcgctccagctttctccctggtctttctaacagtttcgggccacgagaaaatccaaccccttctaacaaataataaacgcaaactcttctctgtccccagaccaagccattgtgaaaagacaagacatcgtcttttaaataaataaaagtattctcaatatcattcgttttttattttcaaacctaaaagctgggcttcttttccttttctctccttttctttttctttctttatcattagctttctgccctaagtgtgcgctaataaagagctaagttgctagttcaagtgtgtttaacctgatggagcaaacacccagcagcaaccggtcgcgctcgcggctgatagcgccgcgacctctgcgcgtccgccccggccggttcccattctcaagtgcctggaccctgtcacttccacctgtcccagtcccagccgtgagaccagagcaggtgactgttcagcagcccctagagttcccgacaccctctgacgggatgtctgagctgtcgctggcccaagagaaaagaggcctccaacaagttggcggagctgccctagctacccgcccccaccccacctctcgcctttccctctcctcctgaaattcgttttcttgggggacagtagcatgcattccaacgtttccttgtgttttctcccacggaagcgagcatcctggaagcagtgcctcgttggaaagtcgatgggtttacagactgtctgggtttgcttgttttattgctgtcactttttgtttcgtgtttttgtttgtttagcagaagtgaagagattgagatagaagttagaaggaaaatgggacattgatgagaaagacacagacaagtatatcccttccccaactatattttttaaattaatgttagaaatggcaaataaccgattttcaatacattacatgcaacaggaagttttcctttcctctcattttaattgaaccggccccacggtatctttggaagaaagtttgaattctttatggaggtatttcgaggcctattgtctttgtgcagtgaactttacatcatgctattcaatcacaacctatattctcctggctaccagcaagattaatttaatcattgtaatgcaattattaatactgtttacccaatgctgggtttcaggttggctgttaagaaattaaactctcgctgggtgaccagagctaggcaggggtttcttcatgttgaaatgaaacagtcctctttatttagtctcagggctccagctttcggccaccggctcaattagccaaaatggaaacaattttcattcattgcaataactcactgttctggagatcgctttcaaaatacacactttattatacgctgacctcggtggcgtggagtggcaataaaagaaagaggcagggagatctatctagcccccttgggctataattattagaaattaattgggttcaggaccctgggtagcctagctaaattaatagcttgtctagtggtttaaatccgaattttcagtccacaggagagaaagggagagagtcacagacatgaaatgcagacccaagggacgcctgagtttacttgcaagacactcatctattaaatagtgtccagaatacatttgagttgaggaggggggctgaagtaggagggagcaggggcgacaagaaagaatggagcaagatggggagggaggctgagagtgagcgaaaaggtctcgagttgattttattcgatttttcttgtctgcattgttttcgggaggggttgcatttaggggttaaaataaaaaataaagatcctgtgtactcggagctgtcgtgccggagtaaaagtgaaaagggagccttaggcaaaaggaaattactgcgagcccgcgtgacctttcagggaggtaatcaatcaagtgatcaacagggatatttatcatcgctatataggactacttcgccctgcacaggcggggtgggggtggggctgggggagcgagaggagggtggagacacgcgcgcactcacacacacacactcacaaaagtttgaacaaacctgataagcctcgagatagaacacgtaggctttaatgttaaagctacctgatttgtctgacattgtcagagaaatacacacacatacacatataagcacacatccaggcagcagcggctgcatgaaggtgttaactttgaatgatccgccacgctttgccctaaaagggaagcttgcagagaaatgcgcgctttgaacgccggcgaggcgacagctcagggctagctcggcttccacgtccagccagggaaagggagccacgggccgcaaagggcgcggggcggctgggggcacccctctccacagcgtctcgacgccggggcctgagacacggaacagcctcctcttcctgcgaaatcctcgcgctgccggggcggcatggcacagcgaggcgcgctcgggaccagccggctcagcgagtacgcgcagctggtgttcggcggccgggcgatttctgcccagttaccttctctacctcgtaaaacttgccgttttgtaaattgcgttttcggtcccagatttcttagcaaatcattcggttttacaatcctactccctccccctagttcaacatcctcccatccaacttctgatgtgtatataaggtacggggagcagggagcggtcagggtagctggcttttaataataatgacgatgatgacattaaatagtcgatttaaaatctgggcccccgccccgctcgggaattataatcagcagttctttggagagaacgtcgggctgattactagcccatggggttgaagaaccatttcccgaagggtttatgaaacgcaggttggagtgatgcgcgccgcctcccaggtggcgagcctaggttcctgcagtgtgggaatgtggggccgcgccagggccgtgcctattggcaccaggtgctaagctcgcggtcccccaccagccgctctggccgccctctccgggctcggcgcggcctcctcccgcacagcctagtctgcggcgccctcgcctggtttctttggccgcggcagctctggtgctcacgccgcttagggctccagctgtgcacagtagccgcctgggcgtgggggtgggaaacagctggagcgccccggggaggcgcgggttggggtggaaaggaacccagcaaggaggattatgaggcgagcaaactcctggagctgctaccggtttagaatcaggaggagcaacttcacggggcacggaacttgagctccggaaagaaaccagactgttcctgagcgatgccctgggaagtttggacctcttggggtcccttccattgaaaaaagaattacttggaagagtatttctcaaagtgtaatgtgcatacgaatcgcctgggaatcttgttaaaatgcagattctgattcagtaagcctggggtggggcccaacatttctcaacaggctcctaggtgatgcagatgctcctcgaagtgtagtcgcagaccagcaacatcaagcatcgccaggatttcaatagaaactcaagatctcaggccccaaccaaacctactaaatcaaaattgacattttaacaagtgattcactagaacgttgaagttggagatgcactgcaatagaatgtgcctggccaggttttctttcttctgtcttaaatcaggacgcctctgtgattgaacttcatttcaaatcctgctttctgccgtggtcacgggagaggatggagtcaacgaacctatccacgtaaacgctacatctcctctggcccactgcagaaaccctagactaacatgcattgaccactgagcttaggggccaaatgccacctgcaaggcttccttgattcttgtctgattgacatctcttccagccactttcctcaagcccccctcacccattcagtattttgctgccaagtctatggcttttatttctccctccttacattacagttttttgtttacagatcttccttcccctttcagctgtggacatcttgaaagagattatgccttatattctccactttgttttttcatctgcagcatggaaataggcatttcttcccacataggattaatatataaaaatgctttggaagccatggttgccattgttaagaaaagatggcagtattcagatttcagggccattataccttagataaattctggggtcacaagattgagttgaaacaccttaagtatcaaaccactggaggtacaaatcccagtcctcccttttaccagttgcataactttaggcaaattattgaacctctctgagtcccagttacctcccctgtattattagaataagtatgtacatcttgcagaatacttgtgataattaaagacaatgtatacaaagcacctagtatggcgcctgctacatagtaggaatttaataaatggagctatttagagctctaagctctaacatttcatagtcggcaaaataacgagggtgtgcgtgtgtgtgtgcatgtctgtgtgtgagagagacagagagagagagtcaggggtcttggatactgctcttcccattcccatctgcaataagatagttgcctttagtcagcagactgcccctcaagtagctgaagcctgaggactttgacatacatagaactgactggtacaattagatattaacatttcagtttaaatgcacatgtgtgtgtgtatgtgtgtgagagagagagagagagaggagagagagaatggttttagctatggtttttggtttgttttttgttgttgttgttgttgttgttttgttttgctttgttttgagatggagtctcgctctgtcacccaggctggagtgcagtggcacgatctcggctcactgaaacctctgcctcccgggttcaagcaattctcctgcctgaacctcctgagtagctagaattacaggcacacaccatgaggcccagctaattatgtatatttagttgagacatggtttcgccatgttggccaggctggtcttgaactcctgacctcaggtgatccgcctccctcggcctcccaaagtgctgggattacaggaatgagccaccatgcccggccccttagctatgtatttttaagggattcttgtgtgcttgtgctttcacaactcagtttcatataagtcaacactacactcagttcatctcgtacaagcagagtcctgaccatctcccagtcagcctgtggcagcaggacctgggccacatgctgagggctggtgagactcactgacagaggcattgctcctcccgtggccttaagattgcaagaatttctgcacaatatatacaaagtcagtatttgaagatgtgtaatgtttttatattaccatattctctccctgtgagatggaagccacaaagacaattcaaagagaaagtggttttcaatggaataagcgctctttctctcttctttcttttaaaattatttttacatgcttttaaatttgttcagtgtttcttacattttcacttccataaatttggttgttgcccatactttcaatacatgaaactatttactaagtctagattcctgccaggaaataaaagatttgtaaaattaacacctacaggacttttaaattctttactcaaacaaacaagtgattatggttgacatgagaaaatatagacataaagcaacttaatttgcttaatatacttttaaacttacaagtatagcagactttccacatctttttaaagcacaaactttaggatccatgctgagacagcttataaatgagacttccttgtaacaagatcctcagtactcaataacttaattcccttgacttaggtccaagctagacctggcaaccctcaaactctgctatggagtgaagtcctatagccatgacagagtgtgatacaggtgtgccctgctttatgaaaagccacatcacaatgtgattattcgcttcatgctattttattaaataatgagttcccctgggacatttaaaatatgatttgacttacaaaaatctgatttatactcactttccccagaaacatacctactgaggtaaagctatgtttttaaaaatgatgatgcatgtcccatagcaaatgttttataatgaaaagtccattttcaaagattaagacaagggaacataccaccattctggggttgggaaagaaacaatttctgtacagatcaattgtacacagaagaaactgtagggctcattaattgaattatctactttgagggctcatgtagatatactagaaaccaggaacatgataagatttggacttcaaacattttagaaaatataatgctcttatactgggttttgatagtaaagtgttcaaatcaactttataaacactcttgaaaaatacactttttgaaatgagaagaattttctgttgcatagagaaactgaaaaataattctagggctaggtgcagtgactcatacctgtaaccccagcacttcgggaggctaaggaaggaggattgcttgagcccaggagtttgagaccagcctgggcaacatggcaagactctgtcttacaaaaaaaattagctgggcatggtggtgcacacctgtagtcctagctacttgggaggctgaggtgggagcctgagagttcaagactgcaatgagctatgatcacgccactgcactccaccctgggcaacagagtgaaactctgtcttccaaaaaaaaagaataattctaaaatttgtctgggcttacacccatttagaagtaatagtttatcagcaaaaaatcaccatctaactcatatccaggttttcacttagctgtttgacattgaactggaactctgaaattggatacattggactcataaagatatatgctattcttaagggctctaggagacagcttcaattctagctgcagtggaagcaccaatgcagagaagccaagatagtgaagatattttgatgcatctgtttctgttctgttaatgcttggctgagattttcacatttgtgtccaaaatttctacagaatcaactatcatgcaggtttcttcattaaaccaattgagcaatctggtgtctcttgtgcctcccagagtggggcaatatttaagcagggagcaagggctacttagctacaggaacctcctgttctagtctaccctacacagcactgcctgcttaactttcctgaggcactattctgaaagtgtctttcttctatgacaagtttcaagatccctcagttattgtcaagataaagccccaaatttttgcctctcattcaaaggtgttctacactggggaaatagcaagagagatggggaaacatgagatgtgcaccagaagcagcaaggactttaggcagcctatgttatggaattcaagaagggacttatgggaaatatgtttggaaagataggttggacacatgccacagaggcttggaatgaatggcaaaattttgaggctttatcttgaagacaactgagagatcctgaagattctgaataggggaatgacattatcagaatttgccttaggaagataaagcaggcagtaatgtgaattacacatcctcttcacatgttcagactacccatcttttgagattcaaaacaaatatcacctcctcccctaaagttctgatatgttgtttcaagtggaaaaacaatctctccccatcacaatcacaatctcctatggcatcttagttttacatgttggttttgtctgtatctctatgatctctcttcataggctataaattccttgaggggatatttatatcaactcttcttgtcttccactgctaaggcatattttgctcaaaaattgtactgtctaaatgtaaggattctaatttttaaacaatttgagaaaatcctcaaccattacctttttaaatattgctttttcttcaccctctcaattcttttttcctgttatctgattagatatatgttagatcttcttgctctatcttctgtatttattagcctctctttcatagattctctctattatcttgtgcttacttctgaataatttcctcaagtttatattcaagttttctaattctctctttctctgtatctaataagctatttaaactgacgattaaattttttatcttaattattttttaaatttccataatttatatttgattcttttttaaaatgtgcctgttatcttttcacactgtcttgtcttttttatcttacagttcagttcttgggattttttttgttttttgttttggttttgggttttttgtttttttttttttccagacaatcttgctccgttacccaggctgcagtgcagttgcatgatctcagctcactgcaaactttgtctcccaggttcaagtgattctcctgcttcaaccccctgtgtagctgggatgacaggagtgcaccatgatgcctggcaaatttttgtatttttagtagagacggggtttcaccatgttggccaggctggtctcgaactcctgggctcaagcaacctgcctgcctctgcctcccaatgtgctgggattacaggcatgagccaccgcacctggccaggttaagtttttaaacatttcaaatatatttattttatctgacagctctattatctgaagttcctagggatttttttttcttttttttttgagatggagtttcactcttgtttccaggctggagtgcaatggcacgatttcagctcactgcaacctctgcctcccaggttcaagtgattctcctgcctcagcctccctcaatcctcccaagggattataggcatgtgccaccaagcccagctaattttgtattttttgtagagacggggtttctccacgttggtcaggctggtctcgaactcctgaccttaggtgatccacccgcctcagcctcccaaagtgctgagattacaggtgtgagccaccacgcctggccatgggatctttttaatccttctgtttgttgtacctactaatcattactcagaaaaattgttttgccatactttagaattttaagttgtgagttcaccttcaacaagattttctctgtggaaatcatgtttaaaattacttgacatatcctttcacaatgattttacctttgcttttgttagatgcttcagtgttatcaattttttcactaatttatcagcctggcttttcccaaactatggaggaaatgtaattagaaccacagatgtaagtgatagtaggcctgttggaaagaattgtcaggggacacttttttttttttaacccagaggccagatgagatagaatcttccttatttctttttctagtgagctgatgattttctagaccagcatttcactgattacgtagccctttgagacccagatttatgcaagggtatcagtttttatctccccaattcatgttgggccagagctttatgtcctaactccatgagagttttgaaacctatgccctgaattctcaaggctcttgtctccccttccacaaccataggctgccaggattttgattcccattgtgttgagccccagagactttccttaacgtttttcaagagcattgattagtttttaagcagaatgcctcagtggtttgtgaagggaaggattgcagattatttactccataaaaacactgggaagcctagacctgaaaatacctgtggtgatttgctgttagtgaatttcagttgcacttttttcttgaatccttttatttaaacgaaatatctgactcccaaaacaaaggcagaactgagtgtcacctataagtagaatcacaaaaatagctttttcacatgtttttgatcagcctaaaatcttttgttctacctttcttcactagtcatcaaaatcatattcagccttcaattgtcgtctcagattcagtgttgtccctaatgttttccatgataataatgattatattaaaccagtggtcaaagtgaaaaatacgaagaagaataattacagaacaacaactatttattaagtgcttaccctgtgttaagcattatactggtattttgcatatgttaccttatttttgcaaataactctaagacatttttaacctcagtttactggtcaagaaactgatattcccagaagttaagtaactttttgaggtggcttagccagtagtacattgagccacattaaattgctgatagtcaactagttttttatccacaacaaagtagttttgcatggttcaatctaacaagtgatgaaggtaacattcaaattaaggtctgaccaatttctaacctcatatacctccctttagacaacacggcctcttcaccatgctaattattccttcttgtaggttatcataacactctttttttttcttttattattattatactttaagttttagggtacatgtgcacaatgtgcaggttagttacatatgtatacatatgccatgctggtgtgctgcacccattaactcgtcatttagcattaggtatatctcctaaagctatccctccccgctccccccaccccacaacagtccccagagtgtgatgttccccttcctgtgtccatgtgttcttaacactcttatactatctgtcttcattcagtttcctcatttgaccctcagttacaataaagcatatacatctgttttctccagtggattgtaagctccttgagggctcttccttagctctgtatcccaggccctttgcacagaacttggtacaggataagtcttcagtatgttttttttttaaataaactaagctaggttattcaagttttagtcaatatttatatgcagctaatgtgtttttaaactttactctttcacttcttctttcctagtggcagtttcataacatgatcgcaaatgttttgacattcttcccatcgagacgtgggatctatctatgactcctttacatgaatctggatgggtttgtgatggcttcaaccgacagagtggtgcagggtgatgttaaatgacttctaaggtttggctataaaagctcatgcagcttctgcctaggttttttggtacatttgctctctgcaggctccctcttgagtgcttcatctcagaacccagcagccatgctgtgagaagcccagttcacaaagagagccctcactaggttctctggccaatagtcacagctgaacctagcttttgagctattccagcatacaagccaggtagatgagtgacgatgtccccagatgagttcaactcccagcattttgagttgtccccaggcatttgagtctttccagctgaggtcccagatattgtggagcaaagacacatgagtgtaataaaatgattattgttttacaccactatgttggggtgatttattgtgcagcaataaataagcatagcttctatttggcctgtctggtagggaccactatagcctagtaagttctaaaacctctacagattgggacagtgatagctccttttccccagtgataagagtctggtgctagacggctgttcctgtgtccagaatcaaaactgggtttcaagtggatttcagcttccggacatgttttgagcatttggctcacactcgttttgtgtgtcttacttgctctctgtcctgtaagcctgaacccaaactggttggctgagaacagtggtctcctaactcattattgttactctcttttcttgaggccaaaccttgcctctatcatccctcatactgactctaacatgcctatctggcctacggcagccaagccattcactagaagctgagccctgctactggcccagaagccccattgcccattctaccctcttgttcaggaccactcaaagactgattccagaacaggctgtcagccaagctttgccttcttggactctggcccctccttaaaggggtgcagctctttcttcattaccagccatcctacaaagtacagcccttctccttaccaggatttgttggcaaacagcatggctagacctaccctcttcattgcaattagtctcaacaaatagcctaatagcagacacactttcagagatgtggaggcaaaatgatcagtgtgagtcagtgttccctaggggcaagtgaacctccctgaagctcagaggcagaggcaccaggagttcctggggcagctgtgctggagattctgtcattctgtcctaagcatcattcatgttgagaagtaagcagggacagatgcagtgtttggttaggccagtcctgtgctgtggaagggcatttcttctagttgctatgtgaagcaaccaagcccggttctctgttcctcccaaagatctgtaaactgtctgaaatcttttaataaaaccttcctgcttaaatgaaccacagtggtttttgtctggaattaaaaacactaaatttaccatcttccaacatcttgtgactgtgtgaatcaatcagaaaatcctagagctgtaggcagtttatttaatttttgtttgcaggtcctgacagaaagtatataccattaatattgaagatcaactataagccttaccatggtagtagaaaattagcaagtcctatgcagttacaaacaatgaccaaccaatcaggtgacatattcaaataccattactttcagtaaaacttttaatgttaatattaataatgttaagtaataaaggtattaatattgataaaaagttttaatcattataaaataaatgtatgatttaccttaaaatttaatatttatctcccctttaaaatttgttttgggaaaaatgttttgtaaggaatatatcttacagtaatacacttacataacttattaatctttgccatgcaattttggaattgcatggcaaaaatacttttactgattaggatgcaaaaagtttagaaactattgcttatcaaaaagtttagaaaccggacaggcagggtggctcacgcctgtaatcccagcattttgagagcctgaggcagtcagactgatcgaggccaggagtttgaaatcagcctggccaacacggtgaaaccccgtctctactaaaaatacagaaaattagctggatgtggtggtgcacgcctgtattcccagctactggggaggttgaggcacaagaactgcttgaacccaggaggcagaggttgcagtgagccaagatcgtgccactgcactccagcctgggtgacagagtgagactctgtctcaaaaaacaaacaaacaaaagagtttagaagagtttgtataggggaggagccaagatggccgaataggaacagctccagtctacagctcccagcatgagcgacgcagaagaccggtgatttctgcatttccatctgaggtaccgggtgcatctcactagggagtgccagacagtgggcgcaggccagtgggtgcgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaaaaaacggcgcaccacgagtctatatcccacacctggctcggagggtcctacgcccacggagtctcgctgattgctagcacagcagtctgagatcaaactgcaaggcggcaacgaggctgggggaggggcgcccgccattgcccaggcttgattaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaaccggcagactgcctcctcaagtgggtccctgacccctgacccccgagcagcctaactgggaggcaccccccagcaggggcacactgacacctcacacagcagggtattccaacagacttgcagctgagggtcctgtctgttagaaggaaaactaacaaacagaaaggacatccacaccgaaaacccatctgtacctcaccatcatcaaagaccaaaagtagataaaaccacaaagatggggaaaaaatagaacagaaaaactggaaactctaaaacgcagagcgcctctcctccttcaaaggaacgcagttcctcaccagcaacagaacaaagctggatggagaatgactttgacgagctgagagaagaaggcttcagacgatcaaattactctgagctacaggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagaaagggtatcagcaatggaagatgaaatgaatgaaatgaagtgagaagggaagtttagagaaaaaagaataaaaagaaatgagcaaagcctccaagaaatatgggactatgtgaaaagaccaaatctatgtctgattggtgtacctgaaagtgatggggagaatggaaccaagttggaaaacacgctgcaggatattatccaggagaacttccccaatctagcaaggcaggccaacgttcagattcaggaaatacagagaacgccacaaagatactcctcaagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaaaccagaatttcatatccagccaaactaagcttcataagtgaaggagaaataaaatactttacagacaagcaaatgctgaccgattttgtcaccaccaggcctgccctaaaagagctcctgaaggaagcactaaacatggaaaggaacaaccggtaccagccgctgcaaaatcatgccacaatgtaaagaccatcgagactaggaagaaactgcatcaactaacgagcaaaatcaccagctatcatcataatgacaggatcaaattcacacataacaatattaactttaaatataaatggactaaattctccaattaaaagacacagactggcaaattggataaagagtcaagatccatcagtgtgctgtattcaggaaacccatctcacctgcagagacacacataggctcaaaataaaaggatggaggaagatctgccaagcaaatggaaaacaaaaaaaggcaggggttgcaatcctagtctctgataaaacagactttaaaccaacaaagatcaaaagagacaaagaaggccattacataatggtcaagggatcaattcaacaagaagagctaactatcctaaatatatatgcacccaatacaggagcacccagattcataaagcaagtcctgagtgacctacaaagagacttagagtcccacacattaataatgggagactttaacaccccactgtcaacattagacagatcaacgagacagaaagtcaacaaggatacccaggaattgaactcagctctgcaccaagccgacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatcccactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaagggaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtagcaataatcaatagttcaacaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatacgcaaatcaataaatgtaatccagaatataaacagagccaaagacaaaaaccacatgattatctcaatagatgcagaaaaggcctttgacaaaattcaacaacccttcatgctaaaaactctcaataaattaggtattgatgggacgtatttcaaaataataagagctatctatgacaaacccaagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatgaagctaccaatgactttcttcacagaattggaaaaaactactttaaagttcatatggaaccaaaaaagagcccgcattgccaagtcaatcctaagccaaaagaacaaagctggagtaatcacactacctgacttcaaactatactacaaggctacagtaaccaaaacagcatggcactggtaccaaaacagagatatagatcaatggaacagaacagagccctcagaaataacgccgcataactacaactatctgatctttgacaaacctgagaaaaacaagcaatggggaaaggattccctatttaataaatggtgctgggaaaactggctagccatatgtaggaagctgaaactggatccctcccttacaccttatacaaaaatcaattcaagatggattaaagatttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttataagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgaggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaacaaaaaaaaaagagtttagaaataactgctatgaattcactgttgtgaattaaaagtatccattctttaaagagacttttaaaggtcatctaatgaaatccttcatgaaattttttgatgacagaaatctttcttcaaaaaaagctcctaactacttctcagatactatactcattacctaggtgacaaagtaacctgtacaccaaacccccacaatgcacaatttacccacacactaaacctgcacatgtactccctgaacctaaacctaaaagttggaaagaaaacaatacaaaaacaaaacaaaaaaagcttcaatgcctgaaacaaacaatatactttggtagagtcccaccatccactgctttcctgaagggtcctgaaaagcactgtttgcaaaccatgggtacactagacctctctcattttactgattaggaaaggaaattacttggccaagagttatttaatgatggaactggggctcaacctacattctcaaatctctttttggccaaaaatctttccatcatattacattattctatttaaatgctagatttgaaagagttctggtgatgcttcctaatttgtgtttcctttacagttctgaaatgttgagagatatttgcaaatctgaggctggggagtatctgagaagctggagggaaaagttaaataacctctacctatcaccctgacccctagcacttccaagcaaagctgtttatataagaacattttaaaatgagttccctgtgcattttgtttctgcttccttgcctgttggctttagttgaaagaatctggattggaagcccagccaaacactttcatctgatccaatcacaatcacatcgtcatctgatagaaacgtggcatcacccaaacctctagtctcttgttcacacatgtggactctaatcagcaacggaataagctgtagtgactacaagcaaatatctctgaacttcactgagtttgatgacagtggtaataaaaatagtcttttccatgacgaacactaccagtaagtcaacagttcaagagcgatagttttaagagtaactgatgcattagctcttgtcaatgagattccttttggcagtaatatattctgcggattaagttaaaccaaatgtttgtaacaatggaaatttattcatgttaacagttaggattatcatcccagtgaatatttactatagttacagtcaaatttactcttttggacattgcttattttcatttctttgttataaactccactaaaagcaatagaaagcatcctttaacatttttaaagtgctgcaatttattttcttttaaactggtttttttcttttttttttttttttttttttttttaggggctactctccctttgcccatacagtgatggcagtgagcaataaaagttctggttgagaaagttctgtaagttatttggccacatttgagctcaccatggctggatactacatggcatttgtcctttgatttcaatctgtttcctgccacttggttactttgtggtcacgtgggtgaaaaagagggccagtgttgactttatagcttgagagcttatctctctgtttcctgtacctagagagagatggtgcaggtacagaaaagtccatacatacataaccttccatgaaacaagccttctgctagcttctgcagtcactctggcaatttgtggttgcagaattcagcaagactaagaactagtgctgtgtatcacaagcgcactttgttctttagagaactttgctctgaaattgttctaactctatatttttgtcagttggtatttttgtcagcttttttatctcaggctgtaagtgacactttatcatgttttcagtctgtagaatgaaagaaagagaatgatagataatttgcactttgggttgctttgctgtttgtttgtttgtttgtttcatcactcttggctatatagacacaagagtgacaagtattcccccacaatgaagagtggagaggagcttcatgagtggcttcagagcacctatgactcagatgccttgagagggtccccacagagccttgcatgtaggtgagatggttcctcactcttcccggctaccacaccacagcaagctcagagaaaaccaagagggatggttgtaacaatggaaatttgctcatgttaacagttgggattttcatcccagttaatattgactgtagttacattcaaatttactcttgtggacactgtttgaccagtggaggaggaaactcatttattcccaagtcactcccaagccatcaaacaaacaccagctgcagaagagagcagttgcccagtggccccacaccttccagctaactgttccttaagcatgaactgattgcccatcttcctattacttggtggctgttaaccatagttgcatctataattacctgcaaagctctttagaacactgatactaaggttccaatccaaaccaactaaatcagaatctttggggaagagtcatgaacattcctatgtgttagtagctccccaggtgatttccacttaccaaagtaccttctctgtactaagtctttgacctcatagagatctttgacccattggccctgttgctttttcactaatcatcacatcatcactctcatttcctcatatccagattcccatggtccataattataatcatttccatgattatagaaatttctccatttctccccattattatactttcctggtaaagtcccctaacagggttaaactcattgccacagctactctatacctggaccaaatctcctgaacattcccatggaaaaacacatgaccaaccatgttaaccacttaattttagatccatgttttagaaaatccatggtttagaaaccatgttcaaaggaacctgaaattttgtccttatgttaaaaagtctttacaggttccatgtatgaaataataacaaatctcaattggacacatagcacagctcaaaaatcctattatgctttcaggttttaaatttcccatactacagcttctattctcgctctcaaatctcctatattccctttctctccccaccactcttggctgatgatctggcctcatcattgactgggaaaaatacagaaatcagaggagattccttatacctccaaacctgcaaaaccacccacatctgtattcacactttttgccctccctccatttgctattcattaagcatccctgttcctatgaaaggccagccctcctctttgatctggatctctccttctcttatctgttggggacttcattcctcccttcataagcatacgttgctaatttcttcccagaacttacaaataagcatgttttagtatcttccatcttaaaacaaaacaaacctttcacaattctacatccatcttagctatcataccatgtccttgcttctcttcactttaaaacttctttaaaaaggcttgtctttagtcactcgccccacttcctcgatactctagtaaaaacactattatcaaggtcagccttagcttgcaaccatcttttctttgatatctaaaaggaatctcaagcttaacatgtccacaaacaatctcttttttctagcactgcaaaacaatgtgggccttcctcagtcttcctatttcactcaatggcagccttatccactgagttaagcctttttcttctttatctcatgcccgatgtataatccgtcaaagtgttttgttggccattcttccaaaatatatcatgaatccagtcacctctctccatttcttaccactccaatacaatcaccatgattcctcacttggacagtctcctctcttccacacctgtctcatggcatccattttctgtacagcggcgtgggtagtcttttaaaagcctagatgagatcagttcatgtccaatagcttcctattattcttagaatatatttaaactttttcctgggtctgcatgacctgactcttgcctactcctccaacctcatctcagatcactcctaccacccactcccagtttgccccagcatagagggcccctggatggtccaaaatcactccgtactcagacaaaactcaaaccctttagctcagcttgttctacctaaaattcttgcaccccagaccttcttttggccagctccttcttatctcagctcaacagtcacttcctctccctgaccactcactctaaagtagccaccacctaacacatcactttttattacattatttagttttcttcatggcaaaaaaaaaaaaaaagaagaagaagaagtgattttagtttccattccaaaagtaggtaaagctacttttaaaaatatcctccagcaatttgtgtgaaaaaggaaatgctgggccagtcgtggtggctcacacctgtaatcccagcactttgggaggccgaggcaggtggatcacctgaggtcaggagtttgagaccagcctggcctacatggtgaaacatacatgataaaaatataaaattagcccagtgtggtggcgcatgcctgtaatcccagcactttgggaggccgaggtgggtggatcatgaggtcgggagttcaagaccagcctgaccaacatggtgaaaccccatctctactaaaaatacaaaaattagctgggcatggtggcgcacacctgtattcccagctactcaggagtctgaggcaggagaattgcttgaacacaggagacagaggttgcagtgagccgagatcgcaccaatgcactccagcctgggcgacagagcaagatttcatctcaaaaataacaataataataataataatacccgacctttaagagcacttcctgaattgcgcaggtaagtattactgactttctcaaatggcctttggagaggtttgagatttagtgagaataatcacaattttagttgtagctctgactattcaggtcctttgactaggtcacatggcccaaagaattttggatcatatattctatgtttctctgtctccacaagaagcaccagctcaggggactcctttttgtgacagtgtttaacctaccagtgtctatgatttggagcaagcttaatgataatctaaaggatgatctggtccttacttcttatagtgtaaaagtcctcacatggttaatttaagaaatgactcttttatacattaaatttccttttaataaaaggatataactaattttgtctccttctaagtgatagcaccacttctgcttcagaagctaattaggagatgcccagtttgagttctttgataccattgatgaatgagaaatgtacatgggtaatttttctttactgctaatagaagttaaacagcacatgtcctgtggaataaaattctcttccctgcaataataatagctgttttgttttgacttcagaaattctgaaatctgtgtgtagccaacagtaattactgctcattacaataatcaccatcgacttgatcagtcccctggaacacaagtcaggacctaaggaaatggatttttacctagggtgatgaagaattttacctgaggcccagggcagcctctctgggagccaaatttggtgactgatactagaagctgttaatatgttgaattcctaagtcagaatttttgttttaagtgttttctgagtgaaaccatattcaaaggaacctgaaattttgacctcatgttaaaaattctttacaggttccatgtatgaaataataaaaagagcaagtgtgaataagtgagaagtttgtcaagcaaggaaagtaatagcagcaaccatattacagagatgtggagaccaacctctacttcttggtttaggggttcccttcaaaataacatgtatggctaggagaggggtaggtgttggagtgaaagcaagcattgggggtggcgtacagaatgaaatcataaagtctcaggattgacatggatctgaggcttaaatcccctttccagtattagagtgaacctttactatgtgccaaacattaggtatatttagagttcagaagcaaaggagttggctctgtctttaaggagttcatagttttgaccagactatcggttcagatgcattctttcaggaaggcattcagctacattcaaataaaaaacaaaaacgcatttacagaggcttaactaaatagagtaattttcctcccaaatgttaggtccagaggtgggcaactcagagccattcaggctctggctccaaatatctttgtgctccaccatcattaatatatgacttccttccacaagctagtcactcatgggtgccaggtagcagctctactccagctgcatgcctcctgccaggaaagaaaggagagaaagaacaaagaggagggtaagaaagctgcctgaatcaggaaaataaaatctttcccagaaatctctagcagacattgatttctgtctcctggccagaattgtgtagtaaggccactctatctgcaaagaattttgggaaggtaagtacttaagctaggcatattgccactccaagcaaaaatagagactcttgtaagaaaaaaaaaatgggagaatggggattggttaacaagcagcatctgccatagaccaacaagaacactgacaatgaaaccatggtataatttgtacataatacaaatttcatgcagaaaagcacagaactctctatcttcaggttagggggaggtgtcatggagggtttcactgaggagggtaacatttggctgagtctcaaagaatgaattaaattgtcaaagtacaaaagaaaaatagttgttcatcaaaatatttttatttgccactggcagaaatgtagcttgaacccaaaagtaccaaggtaaggtttcaagcattgctggctccagtcacccaattgatgtcaccaagacccaatctctctctctctttctctccatcctttgattctataatagccagcaagcagctccagatttacattacaccctatcagcagctttagcagttccaataaagctctgagtatgcatctcactggaacaacttgggatatgtgtccatcactctgacctatctccttggacaggaaaatgagatatgttgattggacaaggctgggctccatgtccacctctggaatattattcaaaacacttgaactaaaagcaagaaagaaggttctccaaaggaaaactgtgagtaagtaaagtaggcaaaaagtacaaatgtctcttacagagaacaattattttagtgatgtttagaaggtgtaatgcacaagatacagttgaacaattggctgattttggtgaggggagggaagattctgaaatgacactggaattcaggcttaggtacttaagtatgatgttgtcatgaaacaagctgatgactacacaaacagaaccagtcaaggatgggcaggtgaagaggttggaggcaataataataacgataaataatactaactatactccctggcaaaccaagggaaaggaacagcaggaagcagtttccagtgcttaaaacaaaccactggactagaaatattgatttttaaaaatcttcaggcctggccaggtgcggtggctcacacctgtaatcccagcacttttggaggccaaggcaggaggatcacctgaggtcaggagcctggtcaacatggtgaaacccccatctctactaaaaaatgcaaaaattagccaggcatggtggcaggcacctgtaatctcagctactcaggagactgaggcaggagaattgcttgaacccaggaggtggaggttgcagttagctgaaatcgtgccattgcactccagcctgggtgataagagcaaaactccgttaaaaaaaaaaaaaaaaacgcacaaacaaacaaacttcaggtccatctttgtttacatgggcatttaaaaatgtatttattttaatgtgcaaagcactctgattttaaaaatttcccaaatacatcctatctcatctgtcatctattatactttcagttctcctttcttttttctcttaggtaactaatgtcttaaaacatcaaaacgaggggttaaattagcaacagtttgagatgaacggtgattggaacctgcagccataatgaaaaatagcatctaaatgtttgaagctacatgaagccaataagctgtctctaaatccagtttaattaatgtgcagcctttgtctactccaaagtgtctgaataaatcctcaaaaccaaattcgtattttaaaatacgagttgcccaatatgatgtgagttagcatacaagcagattaagatggtgtttccattttgaatgaatataattcaagatttacaaatcttaaactagatttttcttacacaaatttggtctttcttttagctataacagagaattagtgacctggtttcaaaagaaaaaggacaatttttaaaaatacttcctaaatctcattagttgtattaatctcttaaactgaaaaagactattttgaagctatctctggaattagcacttctacaatactgccataacatattgatatgaatattactcaaaatcgataagaaattccatttctatgcatgttatgaataacacagattattctgaaagaagaataacatacgtaatattattacatatgttacagatactgttaggtgtctagcctacaaccatttctcccttttctcctttcttacagaaccttggctgagtacaagtatatgctgtccttccgaggccttctgcagcagggaagattggccctgccccaatttcagaggatgaatcctgattggtctaagatcaccacactagtcctgttgccttcacagtgactagtgaagcatgtgcttgtgtgattttagaagtcagctgggaagcaactgggaagaatttccttactcaaaaagaagcacaagagagaggccatctagtatttcttagaggttatcttatctgcatgtagcctgcaattgctataactaccttgccaccttgaagtaagctagcctgaagatagccaatatactggataaaacttttgtttaaagatttatctgcttaatattatctcttctgaaaggtagctgtactccataaatcagattgtgaatcagcttcttgtttgataagcgaagatatcaaacatcaaattggttgttgcaaatcaaatgttcacatcaatatgttttttgttccacatctaatcaggagtggtggtaatctgtctagaataatttccaaagctgtgtttaggtgtggatttatttaatgcatttgagagcacaaaacttctcagggtagatatgtagaactaataacataattggaaacttattaaggagtgacgttttatttagatattctttagtctacagaaaatgagtgaatagaaccacatattactaatttaaaacaattatccagctaatttgcttttttgaatagtgtgagtttaagttttgatatttattagtgtaatatccctatggaaccatttaatcatagaagactaatctttccctacaacattctctcctaaataagactttcctgagaaacaaactagaatatttttattcttgaaccgaggactcacttatcttatctaggctgacttactggataaggccatagcatcagtctatgtgaatcacccaattttcatattatccaaagatacattcttttcaacagtgcagcctcttcagcaatcagttccaaaatatgtaggtcaaagggggaactgagtgagaggatgcaatggcttaattccatgtgtaatcactcacagaaaagtcacacacacacacacacacacacacacagacaaaaatgtcctctgacagttactggcatcatgtttagatatgagatggtgtgcttagaacacggcttcagaaatcaatacatcaacaattagctgggcatgggtcattgtaccttaaaaagaataacaatggggtggcattgcccgagaagaccaactgtctggttacctgacaggtgggcattaccttcatgacatcacagaagtgaaaggaatgatccctggctctataattttttttctggagacagagtctcactttgtcacccaggctggagtgcagtggcataaacatgactcactgcagacttgacctcctggactcaagtgatcctcccacctcagccccccaagtagctgggactacaggtatgagccaccatgcctggctaatttttgtattttttgtagagacagggtttcacgtggctggcctggaactcctgggctcaagcaagccccttccacccactagttttccaacgtgctgggattacaagcatgagccactatgccagcctagatttaaaaatttgatctccacagtgcatcagagttatcaagaagactacttcatgataaacacacaggggactgatatgtaaattagaatgccatttattcatttaaataggaaatatgactgtgacaaaagaatgatcattttggcatgtcccgtggtcttagttcatttctgctgctgcaacaaaataccttagactgggtagtttacaaacagcagaaatttattggtcatagctctggaggctaggcagaccaagatcaaggcaccagcagattcagcgtctgctttatagatggagcctccttgctatgtcctcacatggcagaagagggcacacaggctccctcaagcctcttttataagggcactaatcccattcataatcccctcccacaggccccaactctttataacatcaccttggggagttaggtttcaatatatgaatttcaggggaaggggacagaaacactcaaaccacagcacctgtacgtgccttgtaggtagttaatatttaaatcaaattataaccagaagattgcttggtgagcagtaagaaatttgaatgaatggatttattttatatgattcaaatctttgatggccctggattttgatagcctaattcagtcattttcaaaatctattattattttatcaacaataggacatatttttaggataaagtcttacaaagaacacatatacaggtatatagatataaacatatagatacctcggccttctctctctctgttctgattgaactaaggtagcctattcagatccccacatgctcagcaaccccatatactggagggaaccagcagaggatggggagaggaattccagtaatgagggaacatatgcagagatacagaagcatgacagatggtggcacattctggaaactacaagtggttggataagaatggaatatagtatttgtgaggggatggagagagaggaggcggtaagaggtcaggctgaagaagcaagcaagaaaaaaacgatgaaggaaagactttgtagactttgctaaattatttagatcttatatagaaagctatggaaagccttaaaagtatgttcagggggccatagcatgatcaaatttcagttttggaaatatcactatggctgaaaaatagaaaattaggttatcaggaagggtacaatatatgcaaggaatatcgaaggcctgaatcccatgttcctattgccccacccttaccgctttacccctaggacttcactgccataaccagtcttccagatgccagcacctgcattgcatcacctgagagctatctcctactgctggagcccactttgttggctgtggcaggcttgaagtgtcagagaatgaatgtcccagcaacatcttctatatcagtgacaaagagactggtgtataactctggagcatgtgttagtcccagttgggattaaactccagtggcccacggtggtagccatcttgacaacagaacttttggctatttgcccttccttgtctcacttccccactcttctatccttgtggttctcacctcccaaataaattatttgcactcaaacctttatctcagaatctgcttttagagaaatacaaagacaaggctaccatagctgaaggatgatgagggcttgaattaagcaaagagcgggagacaagggaagcaggctagagatacattcaaaggatgtgaagactaaatagaaaagacattggagaattccagcatagtgtacaggttactgatttgggagactaggagatggcagtgccattcaccaagtaaagcaacagaggagaaggaggatttggggaaaaaaatgataggctcagacttgcacaggctaaacgtgaaacaaacatgtagggatgagaagtaggatgttggacataccaactagagctcagaagactggcctacgctggacatacatacttggaaaaatgggttttgtcattttgtgctcagcacatgaatcgtcttcatattaggggaaaataaaagatgagtaaaggcagggccccttcctcccttgagagaaatcaacaggggatcagattccctgtcccaactcattagcaggcagggcataatcatgtaacctggacttgaccaatcagatgcctccatcagaattttcatatattgagagaacgaaacacagagccaaagggcagtctgattattctgggtggatatggccaaattgagagccctgtgtttctggggcgatggcagcagcaataatgttctcccttctatagttcccaataggtcaaactttaggggagggaccaagaatccatgctagtttaccatcatataggaaatacaaggcaaactctttttttttttttaaaaaaaggatcaacattctatttcctaacctgggaagtaggttcatgactattttagtttttgtttgttttatattaagtattcctatgcattttaaacaccctcttgtatgcatatttcacaataaaaaatttaaaacagagaaacatgttttttcaatagaggtaacaaaggagaaattatgttcaagagtgaaaaatccttttcgctatctgggatatgctctctgggatttgttttgaaataagggagaaaaatgaagaagactcataaaatgttgataattgctgagtgacagatatggtggccttttgggatagtctgtctaaattttttaatgtttgaaaatttccctaattttaaagtatcttgagtaggccagtgtgatagggagtggaggatgaattagaagagggaagacacagaggcagaaagtgtatccagggatcaggaaggaagattaatttagggaataatccaagggaacccaatgcctcacacattaaatatgacccatattagttgattgaccttaattcagaaaactggcaactgactggaaacaggactaaactttgtttaatcagaaaactaaagccttggaaatatctgaagatttgagtcaccaatagcccccagattctttcttttctggtaattcagatgcctcagatctcagattccccactcacctgtatgccactaacagctcacattttgctttggtaaactatgaacattttcttctccttggtagcaattatcattcttgatattagtaattacacttttctgctcctaaggctgagaaaagcatttcccccaagtaaattcccagtcttgtcattaatcttggatggccaggattttaaggtgccactttattaccttgctcctcaagctttacagaaccatctccacccccactcctacccacatccctaagaagaggaacatggaatatgtttccaaagggctgtctggagaggatttgagtgacactatcctgggccactaaaaagagccagctcccaaggagggaatgaagtctctgcttttccagggtttccttcccttctattcagtctgaaaagtctgggacacactgcattatacagctttattcaccattttatcccagcatcctatcgggaatttgatcaaaaaagaatcccagaatataaaccagccacacctgcaaattttattacaagcttgttgtttgtttgtttgattcagatgggggaagaatggtggaaaattaagagctacgggaagattgtcctcacagctcagctcctctgctgtgggcttctttccagttggtgcaacaggagatctggggcctgtgtttgcttttcttggcattcacagaggtggtgtctgtagctgaagacactggggttgttgccagaagccctgctggagctgggactgtgtgcgtccaggttccaagatctcatctgctcacagcgatggggaacattttgatcttggcaaaagctctcatgccggcactccatgtccactcgattcttttccctacttttctgaccccaagcagagagcagagtgacctctggacacatgcagctgggcagcaccactgtctccggaattcctcatatctccctggggaacttgaaacagtggacgcaaacatgaatacagactgctagtgacctggtagcacgttcacaacaggccccgtgagaagagaagagcaagccttccttccccagtggctggttccactgtcatgcctgcttcagacaccagggaagtaaatgtttcagccatgtaaaattagcacagtctgaacacagttagaaaaccaaatgcattctctgtaagtgggagatgtgacccccttctttaggctgttgctaatcattaacatcagggtgggtgttctcgaacagtgcctgagccaggccccagctatcatttcgagccctttggaactgcggatgtgtcggcctataaagtcttccaaaactcaggtcctcatttatcactccacccttgacctcctatttgtgagaccctccagcccatttcccgcaactgttacctcattcctccacatcccagcagcacctcacacgctctcacatccatgcacttcagttccaccctcccctatatgcaaaggaagcaatcagctcctcctccacttctgaaccggtgtttctcaacttccaatccacagacaggagaggcaaaatcaaaccaccataccacaggttctctgttataagtgagagctaaagaatgggtacacatggacatatagagagaaataatagacacaggggacttctaaagcggggagggtggcagggagatgaggtttgaaaaattgcctattgggtacactgtttactaattcaggtgaatggcacactagaagctcagacttcattcaccattacacaacatatccatgtaacaaatctgcctatgtacctctcaaaactataccgattttaaaagtttttaaaccaaactactataataaattcattcccccacccatttcctccaccacacaacagcatttccagctcttctttcccaaacttttaaactttatctggatacaaaatagagagtttagaggttttggttaatgatgtggttttagttgagaaacagtcttcatttatgtgatataatttttaaagtaatatttattgagctttaatatgtactaggtacctgatgaagtattatcctattcaatctttacaaccacctttctgcagataaagaaatcgtccagagagattaatttgccaaaggtgatacaactataaaatggtagagctagaatttaaacttaaggcaaattaagttctgaaaacaatccggagcctagagtccatgcttttaatcacactatatatcatttcccaatccctaacagcacccctcttttaaaatttcttgccctctttttgtactgccccttgccaagatcatgattccctaccaacttcaaggaaagtttgccatattactccatgatgctaaccaaaacctacccctccatctttttctctgctatcaccctagggctctacccaggttaattactctgagaactctttaatacccttgtatcagtcaggatgcttttggctacaagaatctaaactcccaacttaggctaacttcactgataaggacatttagtttacataacaggaattgttaaggataaatcagaattcgtggctacatgactgagcagctccacaatgccatcaacaattcaaggatcaaggttgttgctgtctccctgctctgtaaacttaatcctacagctggttcccctcaagagttgagggcggctgccagaagcaacttgctccacgttcttccttgctattgtgcctgagtggtaaggggtcggggggactctcctccaactatgtctgattggaccatatgcccaaccctgccagtaacaggggaatgtacaacatgatggatttaatcccaaattcctgagcagttatctgacagcctgtagctgccagctccttcagagactgcctcagcaaagagcataaacttttcatgtagcatcaagccaatgattaagcaagatggtggttctagggcccagccatttccacccagtgcaagactcctctagttggcattcattgccctggagctcctaactggaaaggcaaagagtttgtcagatctgcctcatggtctgttggctcttcctgtgcaatccttcttcctcctcttttcctttcactggtgttactccttaataagcctttgggactccatctcagtaccccctccccagagaacccaacctacagcagtaccctgctagctaactatgactccatcttcaccttctgtctctattccacccacatatcttatacctccagaaaatctgtcctacaccatctacattccacccctccttctaaaactgcttttcatctgccttaggaccttcagtcctttaacccatccccattcttagtccaccagccaccatctatgttcccttgcatcatgcctttgcctggactgaatctttaccacaactttgctatcacctagtttctcccctcccaacccttagaccaatccccagccctgggaaagctatagtaaagcatcctttctcccctcctaggtctactgaaagaaaacctgaaaactgggtttaatggcttaatgaaaaatccatgcgatctaactttaattggaccctcaggatggctaagtaatcattttactaatctctgtagacttccactgcattgatgccaaatgttttctctcttcacttcctaatgtcccttcctcctaatttctcctcatactctgaggagggattgttaacctccttctttttctgttgatcaagtatgtagtctattgcctttacttatccagatccatcacacctctctttcccttggagaaatggccagccatgggcatgtgaatcaagccagaccaacaaaacccttgtcaaaactattaagggagaaaacttttgcttgtttgttttggagattgctaatctgtaaagaaaaaagtctggtgctataagcccccatattgttccagaagggaagagcctttctaagaaaaagccagaggaaagcagatcaggccctgatggcatcctactgcttccagatccacctgtcttaaagctgtcaccccatgagacttcaattacgtgttccaacaaattctctttatgtgtctgtactttcagccaagggttgatatataaactcctttcagtctccaaatttgtctctatctttacctattctgacacattctcacaggcctctgacagaggtattgttcttgtttgtatagttttcctcctgtgcatttttcttttggactttgtttgatcacattgttttctccaatgtcttcttcctcattgcccgtattcacgattggtattggctgaataaatgttaccaagctatttcaaaagtgggtctttaatgaaactagacagaacacacagaacacatttctgaaggtgtaagaatgtggctctttgacagtgactttatttgcaggtgagcgaggtggagtcattccagaggacggaaggagaactttgacacaatttctatccttatatgttcctcaaaaggatgctaagatctcacctcctcactcacttcacctccatttggcagtcagtacgcccttgaagaattgccttgtggcacacaaaggtgagaagaatatgtgctgtactgttacgtgtaagagattctgcagagttgaggggacttaggaggagggagcagactggtgcatatcagcagcccttagctgccctcagaaacttttcaatgcccagtagggtttggttgttgttgttttcattttctttttcatttaattttaagtagataatatatttacatgatttaaaattcaaatctatataaaaagatatacagagaaatttcagtccccggcccctccacattttccatcaagttttctgaagttttcagtttatgcctctgtgttagtttctattgctgcataacaaattgtaacaaacttagtggctttaaacatatttattatctcatagttgctgaaggtcagaagtctgagcaggatgttcataggttttctgttcaagtcctcacaaagccaaaatcaagatatcagccaggactgcagtctttctagagctcagggtcttcttccaggctattcagttccctatagctgtaggattgaggtccttgtttccttgctggctgttgacttggagttgcccttaggtctgagatgccatcctcagcctctagccacatggtccccttcacatgcagttaacaacatgtctgttttctttcctctaggccgatgaagagcatcatattgactggtcccatgtaaactcaaggagaaggggatgatacaaggcatatatatagttggtggacagaatattgggagtcatcctaaaattctgcctaccacagcttccattgttgttcagcttattaaaaataaaagcaaagcaaaaatacacacacacacatacatgcacatttccccattaaacaacagtggcatataatatataccttactccatattgttttttgcacttaatagtatatctggagtccattttttagcagtatatatcatcttcatttttttgtagtagttcagttctttattaaagtatactatatttattcaaccatatttatataccatatgccataagataacaccatatttattcaaatattttctaactcttagtcattttgattttttcctatattctctttgctattacagatagtgctgtaatgaatagtttgcatagccttttttttccccgggtcaaagaaatgtgctagatgttgtcaaattcccctatatcaagttgacaccattttgctttccctccttcaagatacctggtacggtttttatttgtgattttccttttgtgagtgaggttaagcaacttaaagggggaatttttattcatttttctgtgaactgtctgttcatgttctttgctattcttctattgggttgttgggcttctcacagtttctagaggctctcaagtagtttaatcattttcctgtgatatggcaagtatttttcccagtttgtcactgtcttttgacttatgttgttttgctatggaagaaactttcttatatgttgttgaatgtgtcagtctttcatttcagggcttctgaattttgaatcagagacagaaaggctttgcccaatcaataaacataatccaacatataaacagaaccaaagacaaaaaccacaaggttatctcaatagatgcagaaaaggccttcgacaaaattcaacagcccttcatgctaaaacctctcaataaattaggtattgatgggacatatctcaaaataataagagctatttatgacaaacccacagccaatatcatactgaatgggcaaaaactggaagcataccctttgaaaactggcacaagacagggatgccctctctcaccactcctattcaacatagtgttggaagttctggccagggcaatcaggcaggagaaagaaataaagggtattcaattaggaaaagaggaacacaaattgtccctgtttgcagatgacatgattgtatatttagaaaaaccccattgcctcagcccaaaatctccttaagctaataagcaacttcagcaaagtctcaggatacaaaatcaatgtgcaaaaatcacaagcattcttatacaccaataacagacaaacagagagccaaatcatgagtgaagtcccattcacaattgcttcaaagagaataaaatacctaggaatccaacttacaagggatgtgaagggccgcttcaaggagaactacaaaccactgctcaatgaaataaaagaggatacaaacaaatggaagaacattgcatgctcatggataggaagaatcaatatcgtgaaaatggccatactgcccaaggtaatttatagatttaatgccatccccatcaagctaccaatgactttcttcacagaattggaaaaaactattttaaagttcatatggaaccaaaaaagagcccgcattgccaagtcaatcctaagccaaaagaacaaagctggaggcatcactctacctgacttcaaactaaactacaaggctacagtaaacaaaacagcatggtacttgtaccaaaacagagatatagaccaatggaacagaacagagccctcagaaataataccacacatctacaaccatctgatctttgacaaacctgacaaaaacaagaaatggggaaaggattccctatttaataaatggtgctgggaaaactggctagccatatgtagaagctgaaactggatcccttccttacaccttatacaaaaattaattcaagatggattgaagactgaaatgttagtcctaaaaccataaaaacccaagaagaaaacccaggcaataccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacagaatgggagaaaaattttgcaatctactcatctgacaaagggctaatatcaagaatctacaaagaactcaaacaagtttacaagaaaaaaacaaacaaccccaccaaaaagtgggtgaaggatatgaacagacacttttcaaaagaagacatttatgcagccaacagatacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggacggtaaactagttcaaccattgtggaagacagtgtggcaattcctcaaggatctagaactagaaatcccatttgacccagccatcccattactgggtatatacccaaaggattataaatcatgctgctataaagacacatgcacacatatgtttactgcggcactattcacaatagcaaagacttggaaccaacccaaatgtccatcaatgatagactggattaagaaaatgtggcatatatacaccatggaatactatgcagccataaaaaaggatgagttcatgtcctttgcagggactcgaatgaagttggaaaccatcattctcagcaaactatcgcagggacaaaaaaccaaataccgcatttctcactcataggtgggaattgaacaacgagaacacttggacacaggaagaggaacatcacacaccggggcctgtcgtggggttgaggggaggagggagggatagcatcaggagatatacctaatgtaaatgacgaattaatgggtgcagcacaccaacatggcacatgtatacatatgtaacaaaccggcacgttgtgcacatgtaccctagaacttgaagtataataaaataataataataataaaattaaaaaaagaaaggctttgcccacttaatgtttataaaggaacccactatgtttttttcttgtactgcatagttttattttttatacttaaatatctaatctacttgaagtttgttctattatcttgtttaaggcattaatccaatgtaatctttttcaaatgtcttcccaatcaattgttcaatcatcaggaaaactgaggaacaaaagtcaccagaaaccaacatcaaagaaaaaaaagctattcttcagtagtttaaggaggtgcagactttctcaagactgtgataaagggaagtaacactgcttaattatctgaccaggtatgcaatgccaagtgccagacaattttattgagctgaacttgaagaacatttaaaccatgtaaactacagagagaatatggagaaaaaccactgatttcagagcaagaacatgtatactttctatgcttgagttgataaagtttcccctcatccacaaatgctacaaaactaaaatcttagtcttctcttatttttttcttttcaagttcaaacctttattaatgttcttaaggtactctaattttttaaaaaatttacaaacagtaaaattcactctttagggtatacagtttataagcttcaaaaatgcatagaattatgtaaccatttccataatcaagaaacagaacagtctcataatctccaaaaaattctctcaagctactcctccccaaaccagaatacccagaaaacctggcaaccattgatctgttcttcatccctacagtttttccttttctaaacattatatgtcatataaatggaatcctactgctacagtatgaatgtttgtgtcctcccaaaattcatatgttgaaacctaatccccaatgttgtagtattaagagatggggacttaagggaggtgactaagtcatgacagtggagcccttgtgaatgagattagtgtccttataaaaaaggcctaagagagattgtttgccccttccattgtatgaagacatatagaaggtgccatctatgaggaacaggctcttaccagacacaaaatctgttgacaccttgatcttggacttcccagcctccagaactgtaagcaataaatttctgttgtttataaattacccagtttaaggtattacattatagccacccaaatgggccaagacacctactttatgtaacctttttagtttggcttctttcactcagcataatgcacctgagattcatccatgttgttatgtgtagaaataatctgttctttttattgctaagcagtactccatgagatggatgtactaccatttgtaccaaaggttatttggaatatttccagttttcagtgattataaacacttgcacacagattttcagcatacagatcctgcctgtattttgttaaatatataccaaaacatttctttcttcagggagacggtgctatagtaaatggtactgttttctcactgctagtatagaagattttttttctgtattctgttaacttgctaaactcacttattatttctagaagcttttgtagatgccttaaagttttgtatgtagacaatcatatcatctgcaaaagtgatcattttatttgttccttatctatccacagatgctcttcgacttacagtagcattatgtcccaatagatccattgaaattgaaaatactgtaagacaaaaatgcatttaatacacctaacctactgaagatcatagcttagcctagcctaccttaaatgtgctcagaacacttacattagcctacagttgggcaaaatcatctaaaacaaagcccattttacaataaagtgttgaatagctcaagtcatttgttaaataccatacattatgccaaaatggagataatgggaccttgagccctcaggaacgagatggcggttctccggaggctgagtgccctttacggtgcccaaggaggccgagctctgttgctgcgaaccccagtgatcagacctgctcatatctcagcatttcttcaggaccgacctatcccagaatggtgtggagtgcagcacttacacttgtcaccgagccaccatcctggctccaaggctgcgtctctccactggactagcgagagggttgtcagtgttttgctcctgggtctgcttccggctgcttatttgaatccttgctctgcgatggactattccctggctgcaaccctcactcttcctggtcactggggccttagacaagttgttactatgttcatggggatgcctcgcagaaagctaccaaggcagggcttttggcactttcagctttaacctttactgggctttgctatttcaactatcacgatgtgggcatctgcaaagctgttgccatgctgtggaagctctgaccttttttacttcatactttgaagaattgatgtatgcctctttgcctctgctttgtcatgccattaagcccacaataacgaagaaataacaggtaagtccattggtggatagccttcttctcttaatcacaagattattttcagaacttagtctttgaggaaaacgtttgagaggagttacatctaagttgtgagactgagttctgtattctggtgagttaacggggttgcctcccagcttcttataagactcacagtataactaaacatgatatatgagcttttgccttttaatttatcaatctcttaaagagaatccagctttattactattagtatatgatcaaacttccatatttgccctgggaataatggacaaagggaaatactcttaattcatgaataaaaactttgcagaaaattagacggtgtttaatttttgaaaacttccctctgtagtcagtagataccacctactgatggctacatatactagggaaattttaaaattaggaaatgctgttatctcacattataaatttctaaatcctaggaagaaatgcttggaatacttctgaatatagagaagttccatttaagggcaagtttccccttgtatacatatcaaaatattaccaattgtaaactgagatttaattctcaaatgtgttctacttgttctaaaacaatctgtccacagatataaaactataagtaataaattgttattttcgcacaatgggaatctctaatgtgaaaatgtattctatgaaaataatttgtttaaataaagcgttgtataataaaaaatggagataatgggtttcataccattgtaaagtagaaaaattatagatcaaaccaccataaatcagggatatctgtatatgccttctatttatttttcttgccttattgcattgaaaaaaaaccttcccgtatgacactgaataggagtaatgagagtggatatctttgtcttgttcccaatattaggcaaacattctttcaccatgaagtggatgttaactgcagattttcttgaagatgccttttgttaggttaaggaattaccatctgttctttggtgactgagagttttcatcatgaatggatgttgaattttatccaatgattcatcttcatctatttatttgatcatacggtttttcttctttaagttgtttatatgatgaatcacattgacttttgaatgttgaatctaccttgcattcataatataacctggtcatgttatattaccctaattatgtattgctggattagatattgcttatattttattgatgatcttgcatctgtgttcatgaggaatgttgatctataggtttctttactcataatgtctccgtctggttttataatagggtaatattggcctcatagaataagttggaaagaatgtcatgctcttctattttctagaagagattgtaaagaattgttttctttcttaaatgtttggtagaattcaccagtgaaacaatctgggcctaaaatattttcttttctttttttttttttttttcctgaggcaagatctggctctatcacccagtctggagtgcagtggcacaatctcagctcacttcaacctctgcctgtccagctcaagccatcctcccacctcagcctcccaaccaagtagctgggactacaggcacccaccaccatccctggctaatttttgtatattttgtagagacagggtttaccatgttgcccaggctggtcttgaacttgatccacctgccttagtccccccaaagttttgggattacaggaatgagccaccacacccagccaaattttttttctttgaaaggtctttttaatacaaattcaatttcaatttctttaaaagataagggactattcgtgttatctatttcttcttgaaggaattttggtaatttgtgtcttctgagtatgtcatttaatctaagttgttgaatttacagacttggagttgttgataatcctcccttattattcttttaatatcagtggaacctataggtgacatttcctctttcattctaatgttagcctatagttaggcaaaattagcctgcagtcaagtaatttatgtcttctctaaggtttttcctggtcactttatgttaagaactgtgaagggttggagattttaccctacttgcaaactaagaaattaggctgccagttttgtagattctggtggaagacacatgactcctaagtcagagacaaagtttagtttagtgcttacagcagtagcagcagccagccagcgtgtcaagatttttgcaccagttccctgggcacacattcccacaggtcaacacaaagaggtctagatgatacctgaaactgcagtggcttgtactgcaggaaaggaacactaaacttagagcaccagaatcttttatattgagagtaagctttccttgctccagagtgagacactatctccatcttccagggatgtttatagacattattggggggaaaaatagtccagaacaaagggtagtcagtgtcttactcaaaaaacatgtagaaaagtgagagatccataaagagttgtttcccaacactctggttagaaattgattgattatattgatcatttcaaagaaccagctttcatttgattgctattcactgattttctctatttttatgtttacaatttcattgatttctgctcttaattttattcttttcttccttctgtttaatgtgggtttagtttattctcctttttctagtttcttaaagcagaggcttagattatttatttgacatcttttttcttttctgatgaaagcatttaatgctataaattttattcagtactatttcagctacatgccacaaatttttgatgttttatttttattttaattcagttcaaaatatggcctaatttctattaagactttttctgtaaccactgggttttttaaaaatgtgttgattaattttcaaatattcatcaattttccagaaagctttgttattgattccaagtttaattctgttgtgattgaaacgcttttttaaaactgttatagtttcaattattttaaggttactattatttatatcccagaatatagtctatcttggtaaatgttccatgtaaacctggaaagaatgtgtattctgctattgttgggtggagcataaatgtcaattcagtgctcaatttagcagcatatatattaaaattggaatgatataaatgtcaattcagtcacgttggttgagaacattgctcaagtcttctgtatccttgctcatttttttctacttctgtcaattctgagagaaaaatttttaagtcttcaaatataattgtggctttgtctatttcttttctgttctatcagtttctgattcatgtattttgatgctctgtcgttagacgtatacacatttgggattgttatgacttcttagtcgtagaagaattagtgaattgcttattttttcattatataagtgcccctctctttaactctgacacttttccttgctttgaagtccattttggtgttaatatggtccctgtcatttgtttggaataatgcttgcatggtatatttcttctatcctttcatttttttttttttttttttttttttttttttttttttttttttttttgagacagagtcttgctctgtcgcccaggctagagtgcagtggcgtgatctcggctcactgcaacctccgcctcccaggttcatgccattctcctgcctcagcctcccgagtagctgggactacaagcgcctgctaccatgcctggctaattttttgtatttttagtagagacagggtttcaccgtgttagccaggacggtctcgatctcctgacctcgtgatccgcccaccttggccttccaaagtgctgggattacaggtgtgagccaccgcgcccggcctatcctttcacttttaacctatttatgtcactgtctataaaatagatatcttgtattcaatatatagccaggtctcttttttatccaatctgaaaatttctttttttaattagtgtctttaggccatttacctttaatgtaattatggatgtggttggatttgaatttgccactttattacttgttttctatttatcccttctgtcttacattagtctgtttttcctttctcatatatttcctgattatttggatatttatactctctcgttttaatatacctattggcattttttgctatatctccttttattctttttagtggatgctctatggacaatatacctacacaacctttagttgtccatttagtgttaatattagcacttcgagtaaaaggtattagacgtaagcaggagaaacaaaaatctctttagccttcccttcttttaagttgtagttgccatttatagtgtaacattgaaacctccactaatcgtacaatttttgctttcaataatcatacatatagatatattttttagagacaggatcttgctattgcccaggctgaccttgaactcctgagctcaagcaatcttcacacctcagcctcctaagtagctgggattaaaggctcatgccactgcacgcggtagtcatgcattttaaagaacttactaggaaaaaatattcttttacatttacctaaacacgagttagttctccctttattcttaatgttctaactttatctctcttatgatttcctttcagcttgaagaatttcttttagcatttcttttagagcagaaaatgtctgatagcaatgaattttcttagttttttttccctctgaggttatctttatttctccataattcctgaaatatattttcactgattgcagaattctggattaatagctcttttctttaagaactttaaagatgttgttccattgtcttctaagctatgtaggatttttaaagatctttaagaactctttttcttttgtctccctcttttggtttttataagtttgattatatctgtctgatgtgattttctttgactttataagataaccttacgtgtttcaccaaattggaacgttttcagccattattttttcaaataatttttcttcaccaatttttttttcctcctgggactgcaattacacaaacgttttatctcaaaatactgtcccacaagtttctgatgatccgtttgtttttaacaaatatttttctctcagttctttacttcggatgatttctattgaacaatgttcaaattcactgacttttcttcaccatctcatttctgctactgagcccatccagtgaatttttttttatttcacacattatcttttttagttctaaaattttcatttggctcttttgattataattatatttatctactgaaaactcattttcaaaatttcatttatttcaaatgtgttcactattgcttcattaagtttggttataatagctgttttaaagtctgtctaataattccaacccctggataatcttagggttagtatctgttgattgtcttttcgcttgaggattagtcatgttttcctgccttttcatatgttgagcagttttagattctatctcagacatttttaatacattttatactatgaaactcgtagtcttattaaaattctttggagaatgttgactttttgttattgttttagcaggcaaacagtatggccgggttcagactataaattgtccttccttctttggtcaattagtttaaatgttagttgttttcaaatcttttgccatgcttctttgggtctacactacacacgtgcctctcagaggttagtctctgaattgagtgatttatgtcatagatcactcctcaatacctttgttatccagctttggacctgttttatgcctttaaagctcaatcttgcaacataagattccaacatgacacttccttcccatcaagtctaacgaattatatggatgttataatacagtcaaaagacatgtttttccatcactgttcctttgtggcatttgttgtcaccttcctgtcatgtcagcttaagtgatttctatttaaatcacagaactccgaaaaatgattttcttctttccattgtcaaaagaattattaaagttgtgtttgtctttaataccgaaaaaaagccaatacaggtgaaggacactcttcaccattaggtgactttaacccaatttccgtcttagtctcaatggatctctcttgttcagagagctttcttgcctttccatctcttccaaggataataaatggatttatgcatgaagggctgttgaattttgtagagggtcttttctgcatctattgagataatcacgtggtttctgtctttggttctgttatatgatggattacgtttattgatttgtgtatgttgaaccagccttgcatcgcagagatgaagccaacttgatcttggtggataagctttttgatgtgctgctggattcggtttgccagtattttattgaggatttttgcatcgatgttcatcagggatattggtctaaaattctctttttttgttgtgcctctgccaggctttggtatcaggatgatgctggcctcataaaatgagttagggaggattccctctttttctattgactggaatagtttcagaaggaatggtaccagctcctctttgtacctctggtagaattcggctgtgaatccatctggtcctggactttttttggttagtaggctattaactattgcctcaatttcagagcctgttattggtctattcagggattccacttcttcctggtttagtcttgggagggtgtatgtgtccaggaatttatccatttcttctagattttctagtttatttgcatagaggtgtttatggtattctctgatggtagtttgtatttctgtgggatcagtggtgatatcccctttatcattttttactgcatctatttgattctcctcttcatgctaaaaactctcaataaactaggtattgatagaatgtatctcaaaataataagagctatttatgacaaacccacagccaatatcatactgaatgggcaaaaactggaagcattctctttgaaaactggcacaagacagggatgccctctctcaccactgctattcaacatagtgttggaagttctggccagggcaatcaggcaggacaaagaaataaagggtattcaattaggaaaagaggaacttaaattgtccctgtttgcagatgacgattgtatatatagaaaactccatgatctcagcccaaaatctccttaagctgataagcaacttagcaaagtctcaggatacaaaatcaacgtggaaaaatcgcaagcctccccatacaccaataacagacaaacagagagccaaatcatgagtgaagtcccattcacaattgcttcaaagagaataaaatacctaggaatccaacttacaagggatgtgaagggccacttcaaggagaactacaaaccactgctcaacgaaataaaagaggacacaaacaaatggaagaacattccatgctcatggataggaagaatcaacatcatgaaaatggccatactgctcaaggtaatttatagatttaatgccatccccatcaagctaccaatgactttcttcacagaattggaaaaaactattttaaagttcatatggaaccaaaaaagagcccgcattgccaagacaatcctaagtaaaaggaacaaagctggaggcatcactctacctgacttcaaactgtactacaaggctacagtaaacaaaacagcatggtacttgtaccaaaacagagatatagaccaatggaacagaacagagccctcagaaataataccacacatctgcaaccatctgatctttgacaaacctgacaaaaagaagagatggggaaaggattccctatttaataaatggtgctgggaaaactggctagccatatgtagaaagctgaaactggatcccttccttataccttatacaaaaaataattcaaggtggattaaagactgaaatgttagacctaaaaccataaaaaccctagaagaaaacctaggcaataccagtcaggacataggcatgggcaaggacttcatgtctaaaacaccaaaagcaatggcaacaaaagccaaaattgacaaatgggatctaatcaaactaaagagcttctgcacagcaaaagaaactaccatcagagtgaacaggcaacctacagaatgggagaaaatttttgcaatctactcatctgacaaagggttaatatcaagaatctacaaagaactcaaacaaatttacaagaaaaaaacaaccccatcaaaaagtgggcaaaagatacgaacagacacttttcaaaaaaagacatttatgcagccaacagacacatgaaagatgctcatcatcactggccatcagagaaatgcaaaccaaaaccacaatgagataccatctcataccagttagaatggtgatcattaaaaagtcaggaaacaacaggtgctggagaggatgtggagaaataggaatgcttttacactgttggtgggagtgtaaactagttcaactattgtggaagacagtgtggcaatacctcaaggatctagaactagaaatcccatttgacccagccatcccattactgggtatatacccaaaggattataaatcatgctgctataaagacacatgcatacgtatgtttattgtggcactattcacaatagcaaagacttggaaccaacccaaatgtccatcaatgatagattggattaagaaaatgtggcacatatacaccatggaatactatgcagccataaaaaaggatgagttcatgtcctttgtagggacacggatgaagctggaaaccatcattctgagcaaactatcgcaaggacagaaaaccaaacaccacatgttctcactcataggtgggaaatgaacaataagaacacttgtacacagggcggggaacatcacacactggggcctgtcatgggatggggggaggggggagggatagcattaggagatatacctaatgtaaatgacgagttaacgggtacagcacatgcacatggcacatgggtacatatgtaacaaacctgcacattgtgcacatgtaccctagaacttaaagtataataaaaaataaattaattaacttaaattaaattaatggatttgttttattatttcatctaccaagtatttatcaagtgtctactgtgtgttagaagctattttagacatcgttcaatttttttaaagaactgcctgatgctgaaatgaataggttaccagagacttacttttaagataatttttaagaaaattacttgtctattcaagaatattagctggagaatggcttgaggtgaggaatggactagactcttctcactgtcctttagttcagtgacttctcaagacagaaataacaaggcaagaccatcaaataaacccaaagcatctctgagaaaaaaaaaattttgtttttttattttaagttctggggtacatgtgcaagatgtgcaggtgtttgttacgtacataaatgtatgccatagtgatttgctgcacctatcaactcattacctaggcattaagcccagcatgcactagctatttttcctaatgctcttcctccctccgccctgcctcccacaggctccagtgtgtgttgttaccctccctgtgtctgtgtgttcacattgttcagctcccacatataagtaagaagatgcagtgtttggttctctgttcccatgttagtttgccaatgataatgacttccagctccaacgatgtccctgcaaaggacatgatctcgttcctttttttttttaattacactttaagttctagggtacatgtgcacaatgtgcaggtttgatacataggtatatatgtgctatgttggtttgctgcacccatcaactcatcatttacattaggtatttctcctaatgctctccctcccccagccccccacctcacaacaggccctggtgtctgatgttcctcaccttgtgtccaagtgatctcattgttcaattcccacctaggagtgagaacatgcagtgtttggttttctgtccttgtgatactttgctgagaatgatggtttccagcttcatccatgtccctacaaaggacatgaactcatcctttttgtggctgcatagtattccatggtgtatatgtgccacattttcttaatccagtctatcattgatggacatttgggttggttccaagtctttgctattgtgaatagtgccacaataaacaaacatgtgcatgtgtctttatagtagcatgatgtataatcctttgggtatatacccagtaatgggattgccgggtcaaatggtaattctagttctagatccttgagaaaaatatggaacgcttcacgaatttgcatgtcatccttgcacaggggccatgctaatcctctatgtgtcattccaattttagtatatgtgctgcagaagcgagcacaatctcgttcctttttatggctgcacagtattccatggtgtatatgtaccacattttctttatgcagtctatcattgatgggcatttgggttgattccatgtctttgctattgtgaatagtgctgcaatgaacatacgtgtgcatgtatctttataatagaatgatttatattcttttgggtatataccccataatgggattgctgggtcaaatgatatttctggttctaggtctttgaggaatcaccacactgtcttccacaatggttgacttaatttacattcccaccaacagtgtaaaagttttcctatttctccacagcctcatcagatctgttatttcttaactttttaataatcgccattctgactggcgtgagatggaatctcactgtgattttggtttgcacttatctaatgatcagtgatgttgagcttctttatatgtttgttagtcacataaatatcttcttttgagaagtatctgttcatgtcctttgcccactttttaatggggttgtttgggttttttccttataaatttgtttaagttccttgtagattctggatattagaactttgtcaaaaaaaaaaaaagaattttgtcagatggataggttgcaaaaattttctcccattctgcaggttgtctatttgctctaataataatttcttctgctgtgcagaagctctttagtttaattagaacccatttgtcaatttttacttttgttgcaattgcttttgatgtttttgtcatgaaatctttgcccatgcctatgtgctgaatgatattgcctagattttcttccaggttttttatagttttgggttttcaatttaagtctttaatccatcttgagttaatttttgtatcaggcataagagcggagtccagtttcaattttctgcatatagctggccagttctcccagcaccatttattaaatagggaatcctttccccattgcttgttttttgtcaggtttgttgaagatcatatggctgtagatgagcagtcttatttctgagtactctattctgttccattggtctatgtgtctatttttgtaccagtaccatgttatttttttactgttgccatgtagtacagtttgaagttgggtagcatgatgtctccagctttgttctttttgtttagaattgtctttgctattcaggctcttttatggttctatatgaattttaaaatagttttttctaattctgtgaagaatgtcagtggtagtttaatgggaatagcattgaatctataaattactttgggcagtatggccattttcacaatattgatttttcctatccatgagcattgaatgtttttccattaaaattttaataagctattgtctctcaaattgtagcccttccatactgctgtaattatacctgttcctacttctcatgcttctccccagaagcccacaagttttgaaggggaaataaaagccataatctctcaaaagtactataaactaatggccaaatatctcacctggctgactttgggacaatgttccacattcaaacggtttccatcttcttctcactggtaaagtcaatgggaaaaaatatatagtgaactaactgagctagaaaaataattttattgttctatcaacaaattcctaataagtatgattagcataaatactttcacatcagtagaatgaggcttcactaatgagatgaacacaatacacatctgacataataccaattgcttttaaatatatatacgtgtgtgtgtgtatatatgtatataataaaaattatttttaaaggcaatataattaacttgcatgattcaactggagtttactcccatttactgtttgtgtgattttcagataaattatttaacatttttgagtctccttttgctcaactataaaattgggacaatagttatttgtagtttgttagaatgtaatgcctaatacagtagatactcaattaatgttaggtgaatgtgatccaaagtcaataaaatttctgaaagggagtatatgcatctgtttgaaaagcgaccttgagaagaatttattccaacaatttatgtattttacaaattgaataaagcagaaggatttcttaaaacattgtcacctaaagcagaacaaatctttcttttaaataagtgttttcctgccttaatatttaattcaattagattaggctgaatgtttttggagagacttgaatataataatgcataaaatttgtctacatttggccacaagcttttgctgacacttaatgaaatctttttaattactccagcagcccttgtgttggctgctgtgctggggtcattggaaaactcgaccctgtggtacttgggatacaagaacatcttctgctgattgaagcctataccctgtggaaatgttttaatgtggtccttgaagcatgtcctaagaaatactgtcaacacatattcttccttgtcaggcctttacttggtcaggaatactcaagagctctgtctttttgcctgtagtttaccatgttgtcttccacttgttttcaaatctggtttagctgtgttcaataaagcagagttagatgaattagatgacatcatcaacccttctctcccagagaaaatttcccatcagataaatcactgaaccagctaccatgttctgacacatagaagccacatccctgccacctgatcattcacttgcagcaaaacattttcttaacacagggaacaaagaggcatgcccaatgggccatatgaaaagctggggttgatcacaaacccccagcatgaagaatttcaaaagaagaaggaatgggaaagaataaaaggataacttattcataattcacagtatcacaggtgatttttttaaaacaaacaggccaggcacagtggctcacacctgttatctcagcacttggggaggctgaggtgggaggattgcttgagcccaggagtttgagaccagtctgggcaacatggtgagatcctgtctctaaaaaaatttttttaaatggtgaccaggcatgttggtgtgcacatttggtcccagctactcaggaggctgaggtgggaggatgacttggacccaggagtttgaggctacagtgagccgtgattgtgccactgcactccagcctgagcaactgggtgagactcagtctcaaaaaattaattaattaattaattaattaaataacaaacagaagactgttggactctactgtttaatataaactaaaagataggacataatcctgaagactccatagctaattaaaaaacaactcctaaaaaataacatacgagcaaatatagattactttgggtttggtgatgactttttcagatagaacaccaaaggaataagccatgaaagaaaggattgataaactggacttcattaaaattaaaatgttctgccctgggaaaaacactgtcaagagaatgtaaagacaaaccgcagactggaagaaaatatttgcaaaagatctatctgataaatgactgttatccaaaatatacaaagaactcttaaaactcaacaataagaaaacaacacaattaaaaatgggccaaagaccttaatagacacttcatcaaaggagatctatagatgtcaaataagcatatggacagatactctacatcatatgtcattagggaaatccaaataaaagcaacaatgagataccactatatacctattagaatggccaaaatgtagacactgacagcagcaaatgctgttgaggatgtacaggaatagaaactcttatttattgctggtggaaatacaaaatggtacagctacattggaacacagtttgacagcttcttgcagaactaaacatactcttacaatattatccagcaatcacccttcttggtatttttccaaaggaactgaaaatacatagccacacaaaaacctgcacgtgggtgattatagcagctttactcctaattgccaaaacttaaaagcaaccaaccaaccaagcaacttacgtatttacctttcagtaagtaaatacgtaagtaaattgcagtgcatccagataatggagcattatttggtgctaaaaagagatgagctatcaagccatgaaaaagaatggagaaaacttaaacggatattattcagtgatagaagccaatctgaaaagggtacacatgtatgattccaactatacaacatttaggaaaaatcaaaactatagagacaggaaaaaaatcagtggttgtcagggattagggagggaggaaggaatggattgacagagcacagagaatctttagggtagtaacactactctgtgtgatattataactggtgggtacatgtcattatacgtttgtccaaacctgtaaaatgtacaacaccaaaagggaatcctaatgtaaactatggactttgggtgataatgatgtgtcaatgtaagttcatcaattgtaacaaatgtacgacttcggtgaagaatgttcataatgggagaggctatgcttgcgtggggacagagagtatgtgggaaatctctgtacctttctctgaattttactataaacacaaaactgctctaaaaaatttaagtatattaaacaatccacactgctatatataaacatgtttatatactgattaactggggtgaatagatcttgacaaacataagaaattgccatatccgaagacactggacgtccccccaggtgtgttgttattgttatttacttgtttgtttcattttttatttttatgggtacatagtaggtatattatttatggggtacataagatattttgataaaggcatatagtgtataataaccacatcaaggtaaatggaatattcatcacctcaagtatttatcatttctttgtgttataaacattccaattataattttagatatttttaaacaataaaatattgttgattaaaaccatcctattgtgctatcaaatattagatcccattcattctacctacctatatttttgtacccattaaccatcaccattcctcctccccactgtgctttccaatccctggtaacattcatttcactttctatgtccatgagttcaattgttttaatttttggctcccacaaatgagtgagaacatgtgacagttgtcttactgcgcctggcttatttcatttaacataatgtcctccagttctatctatgttgttgcaaatgacagaatttcattccttttatatctgaatagtactccattgtgtaccacattttgcttatccatttgtctgttgatggacacttgggttgcttctaaacattggctattgtgaatagtgctgcaataaacacaggagtgcagatatctctttgctatactgattttctttctttggggtttatgcctagcagtgagattgctggatcatatggtagttctatttttagtttttgaggaacctccatactactctgtatagtggctgtacaaatgtgcattcccaccaacagtgtataaacattccctttcctcctcatcctacccagcattcgttattgcccatcttttaaagaaaagtcattttaacttggttgagattatatctcattgtagttttgattctcatttctctgatgatcagtgatattgagcaccttttcatatatctgtttgccatatgtcttcttttgagaaatgtctattccaatctttagtccattttgattggattattagattttttcctattgagttgtttgagctctttatatagtctagttattaatcccttgtcagataaatagtttgcaaatattttctcccattctgtgggttgtctcttcactttgttgattgtttcctttgttatgcagaaagtttttaacttgatgtgatcccatttgtccatttttgctttggttacctgtgcttataggctatggctcaagaaatctttgcccagaccaatatcctggggattttcccccagtgttttctattagtagttttatagtttgagatttaagtatttcatccatttcgatttaatttttatatatggcaagagttggggtctagttttttcttagcaccatttattgaagagactatcatttccccaatgtatgttcttggcacctttattgaaaattagttcactgtagtagtaaagatttatttctgagttctttattttgttccactagcctatatgtctgtttttataccagtatcatgctttttggttactacagctttgtagtatgatttgaagtcaggtattatgattcctctggtttcattctttttgcttaggatagctttggctattctgggtcttttgtggttccatataaatttcagaattgtttttttctatttctgtgaagaacatcgttggtattttgatggagtttacattgaatctgtagattgctttgggcagtatggacattttaacaatactgattctgccaatacgtgaacatggaatatctttccatgcttttgtgtccctcttcaatttcttgcatcagtgttttacagttttcattgcagagatctttctcttctttggataaagttattcctaggtattttgtttatagctatacatgggactaatttcttaatttcttttgcagtgtttgcttttggcatatgaaaatgctactaatttttgtatgttgattttgtatcttgcaaatttacttaattaatttatccattctaatagtttccttgtggagtctttaagtctttccaagtgtaagctcatattatctgcaaacaaggataatttgatttcttcctttccaatttggatgccctttatatcttgtttatatctttctcctgtctgattgctctagctaggacctccggtaccatgttaaataacagtggtaaaactgggcatccttgtgttgttccagatcttagaagaaaggctttcagcttttcccctttcagtatgacgctagctatgattctgtcatatatggtttttattatgttaaggtatgttccttctatcctcagtttttgagggtttttattatgaagggatgttgattttatcaaatgttttttcagcattaactgaaatgatcatatgatttttgtccttcattctgttgataggatgtatcatgttgaataatttgtgtatgttgaaccatctttgcattcttgggataaatcccacttggtcatgatgaatgatctttctaatgtgttgttaaattcagtttggtagtattttgttgaagatttttgcatcagtgtttgaatattggcctgtagttttctttttttgatgttcctagttttggtatcaaggtaatactggcctcatagaataagtttgaaagtattccctctatttttcagaatagtttcagtagtattgctattagttcttctttaaatgattggtaaaattcagcgctgaagccattgggtcctgggcttttctttgctgcgaggccgtttgttatggctttgatctcatctcttgttattggtctattgaggttttggatttcttcatactttaatcttggtaggttttatgtgtctaggagtatatctgtttctactaggttttccaatttactggcatgtagtttctcatagtagtctctaatgttccttttaatttctcagtatgaattgtgatgtctccttttacatctctaattttatttacttgggccttctctctttttatctttgttagtctgactaaaggtttgtcaatcttgcttgtttgtttgtttgtttgtttaacaggggcttattctgttgcccaggctggagtgcagtggtgcaatcatagctcacagcaggcttgatcttccaggttcaaaccatcctcccaccttagtctcccaagtagctgagactacgagtccgcaccactttgcctggctattttctcttttattattcttagtagaaacaggtcttgctatgttgcccaggctggtctcaaactcctgggctcaagcaatcctcccatctcagccttccaaagtgctgggattataggaataagtcaccaccccggccttgtttatcttttcaaaaaaacagctttttctttcattgatcttttgtatttttgtttttgcaaaatgtttattcccactctgatctttattatatgctttattttactaattttgggtttggtttgctcttgctcttctagttctttatgatgcaccagtaggttatttgtttaaatttttttctacttttttgatgtaggcacttattgttataaatttttctcttagtactgctttcactgtatcccataggttttggtatgttgtgtcttcattttaatttgtttcaatacatttttaaaatttccctcttaattttttcattgacccaataatcatttaggagcatgttgtttaatttccatgggctttgtattttcctaagtccctcttgttaccaatttctagttttattccatcgtggtcagagaagatactttatgatttcaattttgttgaaatttttaaggcttgttttgtgacctaatatagaatctatccttgagaatgattcatttgctgagaaaaataatgtgtattctacagccattagaaatgttctgtaaatatttattaggtccctttggtctatactgaatattaagtctaatatttctttgttgattttctatatggacgatctgtccaatgctgaaagtgggtgttgaagtctccagttattattgttttggggcccatctcttccgttagttctaataatatttattttatataactgagtgctccagtgttggctgcatatataattgttatattttcttcctgaattgatcccttttccttatataattaccttctttgtctctttttatgttttttgtcttgaaccctattttatcttacataagaataggcactcttgctctttttgttttccatttgcatggaatattttttccatccctttattgccagtctatgtctgtctttataggtgatgtgtgtttcttgtaggcaataggtagttggggctggtttttttatccattcagtcagtctatgtcttgattagagagtttagtccatatacattaaatgtttttattgataaataaggatttactcctgccattttataattggttttctggttgtattgtggtattttcttcctttctgtcttcttttttgggaaagtgattttctctggttgtatgttttaatttcttgctttacattttttaggtaacattgtaggttgttttcctttaaggttatcatgatgcttgcaaatgacatcttataactcattattttaaactaatgacaacttaacactgattcataaacaaactagaaaaaagcagagaaaactaataaaaaaacactttaacttatactttaactccccccaacttttcaacatttttggtctctatttttatcttattatactgtctatgtcttgaaaaattgttgtacttattatttttgataggtttatattttggtcttcctacttaagacattaatagtttacacaccataattaaagtgttataatattctatatgtgtacatgtacttactattgtcggtgagtgttgcaccttcagatgatttcttcttgctcataaatgtccttttctttcagcatttgttgtaatactggtctagtgtattttctttaagcatttgttgtaatacgggtctagtgttaatgaaatccctcagctttggtacgtctggaaaagtctttatttctccttcatatttgaaagatattttcactggatatacaattcttttgtgtttttttttcccctcagaactttaactatgtcaaaccactcacttccaacctataagctttccactgagaagtctgctgccagacatattgaagctcctttgtatgtttctgtttggttggttggttggattttttgagacaagttctcactttgtcacccaggctggagtgcagtggcacaattacaattcactgcagcctcaatcacctgggctcaagcaatcctctcacctcagcctcccaagtagctaggactataggcacacgccaccatgccatgcctggctaatttagagatatgtggggtttcactgtgttacccaggctggtctcaaaattctgggctcaagtattcctcctgcctcagccttccaaagtgctaggattacagatgtgagacaccatgctggcctcctttgtatgttatttgtttcttttctcttgctgcttttagaatcctttctttatctttggcttttgggagattgattattaaatgtcttgaggtagtcttatttgggctaaatctgcttggtgctctacaaccctcttgtacttgcatattgatatctttctctaggtttgggaagttctctgttattgtccctttgaataaacttcctaccctatgtctctctctgcctcctctttaaggctaatagctcttagatttgcacttttgaggctattttctagttattgtaggcatgcttcattcctttttatttttttttcttttgtctcctctgactgtgtattttcatatagcctgtcttcatgctcactaattctctcttctgcttgatcagttcttctgttaagggactctggtacattctttagtatatcaattacatttttcagctccagaaggagcaggaaatgtaaaaaggaccttatcttgcaacttgggcaacagctcagccacagtaaaataaagcaccaagtagattcctgacgtttctgactacaggctctagctcccagacagtatttctagacccaccctaggccagaagggagtcccccaccctgaagggaaagacacaagcctggctgagttcaccacctgctgactaaagagcccttggtccttgagtaaacatcaatggtagtcatgccatagttgctacaggccttaggcaagccctgagctggcttcaggtccaagaaagatggctacaaataagcacagacagtgaagactacaataaattcctaactcttcaatgcccagacaccaaagaacatctgctagcatcaacaccatccaggaaaacatgacctcaccaaatgaactaaataagccaccagagaccaatcctggagaaacagagatatgtgacctttcagacagagaaccaaaatagctgtgtttgggaaactcaaaaaaatttaagacaacaaagggaaggaattcagaattctgtcagataaatttaacaaacagattgaaataatcaaaaagaatcgagcagaaattctggagctgacaaatgcaattggcatactgaagaatgcaccagagtcctttaacagcagaattgatcaagtagaagaaagaactagtgagcctgaaggcaggctatttgaaaatacacagtcacagaaaacaaaagaaaaaagaattaaaaacaatgaagcatgcttacgggatctagaaaatagcctcaaaagggcaaatctaagagttattggccttaaagaggaggtagagagatagggatagaaagtttattcaaagggataataacaaagaacttcccaaacctagagaaagataccaatatccaagtacaagaaaatttagaacactaaacagatttagctcaaataagtctacctcaaggcatttaataatcaaactcccaaaggttcaaggataaagaaagtatccaaaagcagcaagaaaaaagaagcaaataacatacaagggagctccaatatgtctggcagcagatttttcagtggaaaccttacagaccaggagagagtggcatcacatatttaaaatgctggtgggaaaacacctttaaccctagaatagtatattcagtgaaaatatccttcaaacatgaaggagaaatgaagactttcctagacaaacaaaagctgagggatttcatgcataccagacctgtcctataagaaatgctaaaggaagtacttcaatcagaaaaaaaaggacattaatgagcaataaataatcacctgaaggtacaaaatttactggtaatagtaagtatacagaaaaacacagaatattataacactgtaattgtggtgtgtagactattcttttcctaagtagaaagtttacactgaacaggctgggcatggtggcacatgcctgtaatcccagcactttgggatgcggaggcagacagatcatgaggtcaagagatggagaccatcctggccaacatggccaaagcaatctacagattcaatgtaaactccatcaaaataccaatgatgttcttcacagaaatagaaaaaacaattctgaaatttatacggaaccacaaaacacccagaatagccaaagctatcctaagcaaaaagaacaaaaccagaggaatcagagagtataaatatccaaataatctggaaaaatatgagaaaggaaaaacagactttggatactgtagccttgtagtatagtttgaagtcaggtagcgtgatgcctccagctttgttccttttacttaggattgtctcggcaatgtgggctctttttgggttccatatgaacttcaaaatagtgttttccaattctgtgaagaaagtcattggcagcttgatggggatggcactgaatctataaattaccttgggcagtatggccatgttcacaatattgattcttcctatccatgagcatggaatgttcttccatttgtttgtgtcctcttttatttcgttgagcagtggtttgtagttctccttgaagaagtccttcacatcccttgtaagttggattcctaggtattttattatcttgatagcaagtgtgaatgggagttcactcacgatttggctctctgtttgtctgttattggtatatagggatgcttgtgatttttgcacattgattttgtatcctgagactttgctgaagttgcttatcagcttaaggagattttgggctgagatgatgggattttctaaatatacaatcatgtcatctgcaaacagggacaatttgagttcctcttttcctaattgagtaccctttatttctttctcctgtctgattgccctggccagaagttccaacattatgttgaataggagtggtgagagagggcatccctgtcttgtgccagttttcaaagagaatgcttccagtttttgcccattcagtatgatattggctgtgggtttgtcataaatagctcttattattttgaggtacgttccatcaatacctaatttattgagagtttttagcatgaagaggagaatcaaatagatgcagtaaaaaatgataaaggggatatcaccactgatcccacagaaatacaaactaccatcagagcatactataaacacctctatgcaaataaactagaaaatctagaagaaatggataaattcctggacacatacaccctcccaagactaaaccaggaagaagtggaatccctgaatagaccaataacaggctctgaaattgaggcaataattaatagcctaccaaccaaaaaaagtccaggaccagatggattcacagccaaattctaccagaggtacaaagaggagctggtaccattccttctgaaactattccaatcaacagaaaaagaaggaatcctccctaactcattttatgaggccagcatcatcctgataccaaagcctggcagagacacaacaaaaaaagagaattttagaccaatatccctgatgaacatcgatgtaaaaatcctcaataaaatactggcaaaccgaatccagcagcacatcaaaaagcttatccaccaagatcaagttggcttcatccctgggatgcaaggctggttcaacatatgcaaatcaataaacgtaatccatcatataaacagaatcaaagacaaaaaccacatgattatctccatagatgcagaaaaggccttcgacaaaatttaacggcccttcatgctaaaaactctcaataaactaggtattgatggaacgtatctcaaaataataagagctgtttatgacaaacccacagccaatagcatactgaatgggcaaaaactggaagcattccttttgaaaacttgcacaagagagggatgccctctctccccactcctattcaacatagcgttggaagttctggccagggcaatcaggcaagacaaagaaataaagggaaattattaggaaaaaatcaattaggaaaagaggaagtcaaattgcccctgtttgcaggtgacatgattgtatatttagaaaaccccatcgtctcagcccaaaatctccttaagctgataagcaacttcagcaaagtctcaggatacaaaatcaatgtgcaaaaatcacaagcatccctatacaccagtaacagacaaacagagagccaaatcatgagtgaagtcccattcacaattgctctcaagataataaaatacctaggaatccaacttacaagggatgtgaaggacctcttcaaggagaactacacaccactgctcaacgaaataaaagacaacacaaacaaatggaagaacattccatgctcatggataggaagaatcaatatcgtgaaaatggccatactgcccaaggtaatttatagattcaatgccatccccatcaagctaccaatgactttcttcacagaattggaaaacactattttaaagttcatatggaacccaaaaagagcccacattgccaagacaatcctaagcaaaaagaacaaagctggaggcatcacgctgcctgacttcaaactatactaccaggttacagtaaccaaaacagcatggtactggtggcaaaacagatatatagaccaatggaacagaagagaggactcagaaataacaccacacatctataaccacctgatctttgacaaacttgacaaaaagaagaaataggggaaggattccctgtttaatcaatggtgctgggaaaactggctagccatatgtagaagctgaaattggatcccttacttacaccttatacaaaaattaattcaagatggattaaagacttaaatgttagacctaaaaccataaaaactgaagaagaaaacctaggcaataccattcaggacataggcatgggcaaggacttcatgactaaaacaccaaaagcaatggcaacacaagccaaaattgacaaatggaatctaattaaactaaggagcttctgcacagcaaaagaaactacaatcagagtgaacaggcaacctacagaacgggagaaaatttttgcaatctatccatctgacaaagggctaaaatcaagaatctaaaaagaacttaaatttacaagaaaaaatcaaacaaccccatcaaaaagtgggcaaaggatatgaacagacacttttcaaaagaagacatttaggcagccaacagacacatgaaaaaatgctcatcatcactggccatcagagaaatgcaaatcaaaaccacaatgagataccatctcataccagttagaatggtgatcattaaaaagtcaggaaacaacaggtgctggagaggatgtggagaaataggaatgcttttacactgctggtgggagtgtaaactagttcaatcattgtggaagacagtgtggcaattcctcaaggatctagaactagaaatcccatttgacccagccatcccattactgagtatatacccaaaggattataaatcatgctgctataaagacacatgcacacgtatgtttattgtggcactattcacaatagcaaagacttggaaccaacccaaatgtccatcaatgatagactggattaagaaaatgtggcacatatgcaccatggaatactatgcagccataaaaaggatgagttcatgtcctttgtagggacatggatgaagttggaaaccatcattctgagcaaactttcacaaggacagaaaaccaaacaccgcatgttctcattcataggtgggaattgaacaatgagaacacttagacacatggcggggaacatcacacaccggggcctgagtggggtggggggatgggggagggatatcattaggagatatacctaatgcaaatgacgagttaatgggtgcagcacaccaacatggaacatgcatacatatgtaacaaacctgcatgttgtgcacatgtaccctagaactcaaagtataataaaaataaatttaaaaataaaataaaagtattagaactgataaattcagtaaagttgcagggtacaaatcaacatacaaaacctatatgccaatagtgaacaatgtgaaaaggatattttaaaaagtaatcccatttacagtagccacacataaaattaaatacctagaaattaaccaaagaagtgaacaatctctacaatgaaaactacaaaacactgctgaaagaaattgaagaggacaccaaaaaatggaaaatgttccatattcatggattggaagaatcaatattgttaaaatgtccatgctacccaaagcaacctacagattcaatgcaattcctagcaaaataccaatgacattcttcaaagaaatagaaaaacaatccaaaaatttatatgccaccacaaaagacccacaataaccaaagctaccctaagcaaaaagaacaaaactggaggaatcatattgcctgacttcaaattatactacaaagctatagtaaacaaaacagcatggttctagcataaaaacagacacataggtcaatggaacagaatagagaacccaaaaatgaagccatacttctgcagtaaactcattttcaacaaaggtgccaagaacatacaatggcaaaaagacaatctcttcaataaatggtgctggaaaaactggatatccatacacagaagaattaaactagactcctatctcttgccatatacaaaaatcaaatcaaaatggattaaatacttaaatcttaaatctcaaaccacaaactattaaactattacaaggaaatactggagaaaatctccaggacaatggtctgagcaaaaatctcttgagcaatgccccgcaagcacaagcaaccaaagcaaaaatggacaaataggatcaattcaaggtaaaaagcacggaaaatgaaacaatcaacaaagtgaagagacaacccacagaatgggagaaaatatttgcaaactacccatctgataagagattaatagaaaatatctaataatctgatctaaaaaatgggcaaaagattggaatagacatttctcaaaagaagacatacaatgaaggcatatgaaaaggtgctcaaaatcattgatcctcagagaaatgcaaatcaaaactacaatgagataacatctcgctccagttaaaatggcttttctccaaaagacaggcaataacaaatgctggagaggatgtgcaggaaaggaaatgcttgtacactgttggtaagaatgtaaattagtacaatccctatggagaacagtttggacatccctcaaaaaactaaaaagtgagctatcatatggtccagcaatcccactgctagatatatacccaaaagaagggaaatcagtatatggaagagatacctgcactgccatgtttattgcagcactgtttacaatagctaagatttgaaagcaacctaagtgtctatcagcagatcaatggataaagaagacgtggaacatatataaaaaggagtactatttagccataaaaaagaatgagatccagttatttgtaacaacatggatagaaccagagatcattatgctaagtgaaataagccaggcacagaaagacaaatatcgcatgctctcacttatttgtagtatataaaactcgaaacaattgaactcatggacataagtagaaggatagttgacagatgctgagaaaggtagtgggaaggtagtgggggcagggggaggttgggatggttaatgggtacaaaaaaaatagaaagaatgaataagacctactattttgattctgctgagagagagaaaagagaaaaattaagaaagaaaaaaaaaggcctactatttgatagcacaacagagtgactatagtcaataataacttaattgtatactttaaaataaaaagtgcagttggattgtttgtaactcaaaggataaatgcttgaggggatggataccccattctccatgacttgcttatttcacattgcatctctgtatcaggacatctcatgtaacccataaatatatacacctgctgtgcacccataaaaattttaaaaagctggaaaaaaataaaaaataaaaaataaggaaataggttttatattttatacatatgcttaatacacatttataaaagaactgtgattactttttttttttttttttttgagccaggatctggctctgtcaccctagttggagtgcagtggtgtgatcttgactcactgcaacctctgcctcccggctcaagccatcctcccacctcagctagaactacaggcgtgagccaccacctggctaattttttaaaaaatattttttatagaggcagggctttgccatgttgtccaggctggtcttgaactcctgagctcaatccatccacccgcctcagcctccaaaaaggctgggattataagtgtaagccaccatgcccagcccctaaggttactttttagacaatattgaattatctcaataccttatcattggcttaaccttgtcacacaaccagtatatcccacaaccgactgattcttgttcacaattcaagaaactatgtgtatttaagcaatgctgtatttactaaaaaaaaaaaaaaaaaaaaaaaaaaaaaattagtacatgaaatcaagggacttctgccattgaggaaatgtaatgaactgtttctacagagaaaagttggtggctgccactttactctagtggtgaagggcacaggacttgggagtaaactcacatagactgaatccactatatatgtgaccttgggtgagctacctcatagggggctgtttcctatcacacaatagattcctcatggtgttatttaaataacgcatataaatgctttagcacagacgtttgtttaaactcaatgaaagagggctgctttcattttgaaccttctgttctttaaatgtttttctttacattcatgtagatgtacatgcttgcagaggaaaaaaaataagaacacaaaataggtagaaaaatggaaaaacagtggcctctgtggaacaatttgtggcagttgaaaaaggctttcctagtcaggcatatctcaccaaaggggcccaggagcagtcgagaagctctaattaaaaattcagtgtattcctcaggcaaacccctgtgaacatgcatatattttagaaggagattaacccattaactagtaatatttagcatggcacattaaacaaatgctagtttaatagctagtggcagaattcatcttagggaacagtctctgtttggtgacaaacagaatccttatgtgcgaggactgatgtggaaagaaagagtccttggggcacagctagaataaagcaggaataagatgaagagagcaaaactgttctgcatacgaaaagaacaagggccaaggtgggtggatcacctgagctcaagagttcaagaccagcctggccaacatggtgaaactccatctctactaaaaatacaaaaattagccgggtgtgatggtgggtgcctgtaatcccagctacttgggaggctgaggcaggagaatcgcttgaaccctggaggcggaggttgcagtgagctgagctcacaccactgcactccagcctgggtgacagagtgagactccctctcaaaaaagaaaagaataaggattttggggctgggagcaggagccagtcagggaagaagagcagacttggaagcagaagaaaggagactcccaggccagagaagattgcaactccccagtgggagggatggccaacaacttttgaggacaaaaatatctcaaattttattttaagtggggtcatgaagctgcacaaatataataaataaaattattataaaataaataaaattattaattatattagtgcagctttatgaccccaaacctagggtaagactctacacatagccctgaattgtctggactttgggcagtgaagggatttggataatgtccaggaagaagacacatgcagaaatgggcagaagatataaagagtgggctaattgcacagcggaggagacttccagaaacaaaggtagaatccaatggtctaagtccagagtacaagctatcccaaaagttctggggtaagagtgaaatgtgcagggaggggaagggatgcctcctttcccaccacatttaggaaaaagggctgagtccatctaattaaatctcaaaggatgaagtgacccagctgcatgttggttcctctagctctctttcttcctagctctctaacagctacggaaaagctaaaagaaggacacagagggcctagcgcccagggttgaccaaagggattagaggacaaagctgggagagatgacacataaggggcatcaaatggaggcaccttaacagaagatagttattatgaatagaggccgggcatggtggctcacacctgtaatcccagcactttggtggatggatcacttcaggtcaggagttcgagaccagcctgaccaacatggcaaaaccccatctccattaaaaatacaaaaattagtccagcgtggtggcacctctcctgaggcaggagaatcgcttgaacccaggaggcagagagtgcagtgagctgagattgtgccattacactccagcctgggcaacagagtgagtctctctctctctccccgtgtgtgtgtgtgtgtatatatatatatatatatatattagagaggggcacctgtggcttgagcaagccctgaagagattacaaattaacattttaaatattattcacctaaatttaaatttggatatatgttatttgggtaagtgatcaaataccagattgcttgtgataaattacttagagatattcaatctgtaacatgacaaatacaatgaaaaaataacaggaatttttttaatgaaaatggcactttttcctcccagcagtctgtttaaaagagttaaagccgggcgcggtggctcacgcctgtaatcccagcactttgggaggccaaggcgggtggatcacgaggtcaggagatcgagaccatcctggctaacacggtgaaaccccgtctccactaaaaatacaaaaaaaaaattctccgggcgtggtggctggcgcctgtagtcccagctactccggaggctgaggcaggagaatggcgtgagcccgggaggcggagcttgcagtgagcggagattgcgccactgcactccagcctgggcgacagagcgagactctgtctcaaaaaaaaaaaaaaaaagagttaaattaagacatgaaatgatcatattagccttaattcttctcatttattaattgaacaccttggaaacatgcagataaatgtcccaccttggagaatttgagataagtgtgaatagaaatgaagagaaattaccaagatttaccagttcacactcacaaccatcacactctgtttattcaaagctgcctacagatgcatgatatcaaattaaacctttaatgtattctgatgtcaagggagcttacaatcataaggcctgttcttaggttcacacttgggtctttgtacatagtagaggccataaaaccaggtaaacagcaaaaggctgttgtgaaacaagacaaatgagagttccatgtgttatcaagaaattcaagctgtttcctgtgatgaaaaatacatagatatacatattcattatattcctaagaatagtagtaccataatgcattcatttacaggcatattaatatgacaaaagaaatgatgaaatttggttctttgcctgaagaaagacttgttataaataggaaagctggccaggtgtccagtgatcctaaaaataggtaagcttccactgcgaaagccatcaccacacacgaaataatgagagaaacacaagctcactctatggaaaacatccaccaagaaatagccaaaataattcctttcatttgaccataaacccatcaaaacttcatggaatgtggttacattatttatgcagtgcctgcattcagtaaaccttacatgctgtagcgttcttaaataatgagagagttagacggacaaactttcatgggatttgttctctaatagaaattcaactatcaatgtaaatcttcagaatcctgaggaattttctgctgaaataaacagccaccaacacaaaatgacctagaaatagcttatagctcattcctccttgactcctcaaaactttttttttttttttttgagacggagtctcgctctgttacccaggctggagtgcagtggcacaatcttgggtccctgcaacctccgcctcccaggttccagcaattcttctgcctcagccacccgaggagctgggattataagcacgcaccaccacgcctggctaatttttgtattcttagcagagacaggtttcgccatgttggccaggctggtcttgaactcctgacctcagatgatccacccacctcggcctcccaaagtgctgggattacaggtgtgagccatcgcgcctggccaaaatatttatttttaaaaatctaactaattcagtgtgcaagaaggagtgttataaaagaaaaaaaaatctaactacttaaagtgaatcacttttatcctttaaaaaaaagaaatttgtccgggtgtagtggctctcacctgtaatcccagcactttaggaggctgaggcagatggatcatccgaggccaggagtttgagaccagcctagccaacatggtgaaactccgtctctactaaaaatacaaaacttagccgggtgtggtggcacatacctgtaatcccagctactcaggaggctgagacaggagaatcatttaaacctgggaggcaaaggtggcagtgagctgagatcacgccactgcactccagcctgggcaacggagtgagacactgtctaaaaagaaaaaaataaataaaaaataaaaataaaaaagaaattcaaaaggattataaaaggattatagtcagattctgagaggctggtcctcaactataggaacaaggaaacagtcattttttaatgaaaagtagcccaatactaatgtgtgtctgaagtcttaatcagcatgatgtcatggaaactaaacctatttgataccagcagatgtgacccactttttctttttcattgcattttgtttccggtttaatgttcgggaatgcagtggtagactcttgtcctacctcctagcagttttgtctgcaaagagctgttttcccatccacagtcttccaaagagcaaactgtcaatggaatgattttgacgaataaatgacttgttttgcaatacaaaagcaaaagttacagccgataaacaatcaacttagtaacaaatgttacatattaaaggtatatgtcaatgaaggataacactcattatggaaaaataaaagctagagagttacaggagatatgccaatgttctctcatcatactgcacaatattataataattaggcgttcaaaggaatagatgatattcctttgtacatacttaagatgtggaggataagactatatattatcccttttttaaaaagctcatttattgttgtatcacaaaagtaaagctgtttaacctgtagagcagctattttgtttaggtcttcacctgtaatttttgaaatttttgaaactgtggtgccattacttaccaacgcgagaaatgcactttataaagtgtaactgctcgggttgaggggaccaacaagaggatcagatctaagagaaacctctcccaaagactagtcttcacccctcccccactactcctttgagaaggaaagagtaaatgttagccttgggtacaaaattggcattgttttatttatttcttgctttatttcttgatataaaaaatgtgaaaagcttacaaatttctaggcaaaaagcacacttcaggatttttttaaatgtaagcaaaaaacctctatgggtatataacaagatctgagcataaactttaacagaacaaactaaaacctgctagcttatcctctcttgctcctgccacagaccatctacccacaggttctctttgttcactgcattcagcagccttctctggagctgctctccttgtctaccctggagtgaaagaaggcatagttttcatagtacaaaagtactcacatacttttgtactccttcaaccaacatttaaaaagtaatattgtacaaacttgcaaactgtttctgtcttcaatttacaattttaaataggctgatttcactttacagagtgggagaaaaaaaaatctaagtctgcagttattcatgtgagtgggctttttgctacaggtgaacagatattgccatctactgttgagaaaaaataaaagagttaagccaaaagttttcagccttcttgaggtcttgacagatcataaatttaaaatggaaaaaaaaatgactttatgaaagtagtcagtttctttttacttatacagctatttagcatttgtaatttgagaactaaagagaagaaaaagcataataaaccagaaaactttcttctctaaaatcagaaaaattgctgtgagtaattattcttagtttcgattaaagttgaaagcaaatcatgttttactgagttccatttggcccacaatattagctgctgcaatcgagaagaaatataagtaatgtctctttttaattaccttaacttcatttcaaaatttaccttatgaataggttaatgtgttttatcataaaaatcactggaaacactcatggcaaagtcagtttttttttgttttgttttgtttttttttttttgagacggagtctcgctgtcgcccaggtgggactgcggactgcagtggcgcaatctcggctcactgcaagctccgcttcccgggttcacgccattctcctgcctcagcctcccgagtagctgggactacaggcgcccgccaccgcgcccggataattttttttgtatttttagtagagacggggtttcaccttgttagccaggatggtctcgatctcctgacctcatgatccacccgcctcggcctcccaaagtgctgggattacaggcgtgagccaccgcgcccggcccaaagtcagtttttaactttacatttagctattaatattcttttgaaaaatagagtagctaccacttagccttctttaggcctctagtagtacatacttaagctcaaatttacagaaagcccctttagggcaaaatgctaccataaaagcaatgcatctgagtcagagaacccagccatgttcaacttctcccacaacctctcccactaggaaagggagacagagctctgagcctcagatcaatcaatgtgaggaatgacctgtctttattctggtggctggtgttgagctggaggaaatgatttggtggccgaaattcagttgtttttgcacataaaaaagtattttcccctctaaaaaatatttatttaactctgtcaaccaccacaccaagcaccacaccacgtcctgtaacagctatcttgtattcgaatgacgcgaatgtgaagcgtaatgtgtggattgtgaggaacaagcccccaccatgaatgtctgcgaagaaaagggaaaaagacctttaatctttgcagtgtattaggccaagtatgaaagctgactacacactatgcactatggaggatgtgtctgtgtgtatatctgtgtgtgtgtcaaggggctgatgtttttaaaattggtaactgattttgctatattgacagctccggttccaaccattatgatttattctgctggcttcattaagatattgtcatcataactaaggctggtatagcatttactgttcataaaatgctctcatgcatgtcaaaatttgctcgtttaacatatgtgtactaaataccaaccctgtgcgaggttctcgcaagcttcaggaatacaaagctaaaagacaaggtatcccatctttcaaaaagcttcacagtctggggaggtgaaagggaagcaaacctcacagctggattttaaaacaatgttagatgtcccatgatagaagaatgaaggggcgctaagtaaaatgaaacacagtagctctgtttctgcttggagggacacagccaggatccaggaaggtgtaagtaatcgaaaactaaatagcacatgatctagcagagaagggacattttctgaaaaccacagatcattatgggataccacaggctcactgagtatcagcaggtgagtctggtgaggaagtgtcaggcagaggtgtcctgggcatatatgcctagtgtcacatagggaaggtaaaaaataaaggtgataaaaggaaagcttacaagcagagaaggagcagagtgtccgcaatcccctgaactctcattatcccacagtttcggccctgtgtagatgggccacatgtccatggctaacagtgcagtagaaagggaccctgccctacaatcctgtagggaacagggaacatctatgcacttggatgtcccgtggtcacagaagtagcttgatagaaagggagggtcgggtctctgcagcccagaaactggcatccacctgttctagtgggctaactctaacttgctgagccaactttctactcatctaccaaaaacgggaacatgagcctccagtacatccagatctattgcttataagaggaatgcagaacaggaactgaatgaagtctcttgtccgccgcagcaaggaggtgattcgaaaccacaggtgtcaaggaacaaccaactgttcttgggcagagaagtaataggatatgatttctattttaaagaggtcaccagcattgtacaagataggtgaaagataggagaccagcagggagctattgcagaaggtcagactagggggtctgacccagagcaaagaaggtggggaggggcagtcagactggagagatgccacacagggatgaaatggacaggacttcaagactgcttagatgatggggataggggtaaaagaaggaaagaacagagtctcatattacctggtgtctgacggagtgacaagatggactggggaagacagagtaaggagggagagaaaagtcaataaggctacttttttcaacttattattttgaaataactatagattcataggaagttggaaacatagtacagagaagttccatgtacccttcacttcatctcccctaaaggggacatcttacataattatagcacaatatcaaaaggagacaattgacactggtacaacacatgtgtagttgtcatttgatcacaccagtcaatttacgtaaccacgaattcaattaagataaaaaactatttcatcaccacgaacatctccctcatgctaccccttcacagttacagcccccttccctccaccacccctattccctggcagccactaagctattctccatctctacaatgttgttatcttgaagatgtcatgtaaattgaatcatccagtatgtgaccttgtgtgattggtttgtttcacctagcataatgctggaagtgcacccaagctgttgcatgtatcaatagtttgtttttttattgctcagtgatattccatggtatggatgtaccacagtttgtttaatcagtcacccactgaagaactttttttttctttttttctagtttggggctattaaaaataaaactgctatgaacaattgtgtaaaggtttttgtatgaacataagttttcatttctctgggatagatgtctaggagtatgattggtgggatacattgtaaatgtatgtttagtttttccagaaattgaataaggccaatctttcaagttaagtattattttatccccattttgaaagtaagacatgggaattatggtgattagcagtccagactttggtgacaagtagacttagggttgaatctggcattgccataatcaactatgggatttggcaaattaattaaccctgatatagttctatgtcattttatcccacatgtagatctttataacctttcaatgacttcagaatagcaccagaataatttcctgctttattatacacagaaccagtaggattcctaggtatgaaatgcacaattatgccagttatcgaataaggaaaagggaagctgggctggatagaactgagaatgcaggagaaaattgaacagtttttacttaggttaagatgatcagggggtgtattggagactgtgatgggataagagaataggaagtggctaaggtttgtaactgggcaactgagagtggatctagaataagccagtctcaaggctcatacagaaaaaaatatatgacgtgatatatgatttgatgaaagactcttcagttcagcaagattctggttactggtagtttctaagttacatgtgttgtgagggattcagagatgaaagcaaagggaaggatgaaacgtgtatgatcaagtcagcaaacattatgactcatcctctgtaggtggtttaaggcgaagttaaaaaataaaggtgtatcacattgaggtggggttgacaatgggataagaccatttacaacaagccagctccaggtaggagtctagacaaataggaaaggtcaaatagaagcagcaatttagacaatatatggccgagttcaagaaaaccaacagaagcaacaaagggcagaaatatgcctaagttcaggcaaccagagtcagctattgggaggtcagcagaattatggagcaagggcagtgcatgaatctgattttagaaaaacagactttttgcttatctattttttgctgtctgctgctcctgtgaagccctgggcctttgagtatcagttctagccaggaagagctcaaagacctgctatagtagactatctttgatgagaataaaagattgagattaccttacataagattagtagaggctaatgtattggttaggatgcttttgactgcaataacagtaacacaactgaaagcctcacatgataaagaaatatgtaatgtggcaagtgaggtggctcacacctgtaatcccagcactttgggaggctgaggctgaaggattgtttaagcccaggagttcaagagcagcctaggcaacatagcgagaacctgtctctactaataaaaaatactgccacgtggtggcatgcatctgtagtcccagctaccagggaggcagaggcgaaaagatcttatgaccccaggagtttgatgctgcaagtgagtcgtaattgcaccacttcactccagcctgggcaagagtaagatcctgtctcaaacaaacaaaaagaaatttataggctgggcgcagtggctcatgtctgtaatcctagcactctggtagactgaggcgggcagattgcctgagctcgggactttgagaccagcctgggcaacatggcaaaagctcatctctactaaaaatacaaaaaattagccaggtgtggtggtgcatgcctgtagttccagctactcggggggccgagacgggagaatcgcctgaacccaggaggtggaggttgtagtgagccgagatcacagcactgcactccaccctgggcaacagaatgagactctgccccccaaaaaaaaaaaaattataatatgacacaataaagtctaaggacagggaattccagagcaagtcaaaatagcggcagaacaatagcagcagagcaagtcaaggacaccacccattccatctccctctgcctgccatcctcatacttaccccttatggccacagtatattctcaggataaatctaaaacatttcttttgggggtttaaaatcagaaaatttaaaaattaatcctggttagttaagtgttttggttagttgaattctaactgactgaaattcttctttaggtctttttgttgttgttgttgttgttgtttttctttttttgttgatggtgttgttgttgttgtttttgagacagagtcttgctctgttgcctaggctgaagtgcagtggtgcaatctccattgcaacctgccttccgggttcaagcaattctcatgcctcagcctcctgagtagctgggattacacgcatgtgccaccatgcctggctaatttttgtatttttagtagagacagggtttcaccatgttggtcatgttggtctcgaactcctgacctcaggtgatccacctgccttggcctccaaaagtgctgaaatcacaggcatgagccaccacgcccagcctagatccttctttgtatttcatattttgtccaagatttcactctaacatcaggatcagatcactgtcatggttttagatgaatttcctttattcccattctcagaacatgaatagatgactctaaatatttcttttaaggaagtaagtggtacaccttaaatttgcatagcagtacactttcacatggtttgcctaatctaatctttacaaatatttgtgagttagagagagcagatattaatagcctcattttagagacgaggaaataaaggctgaagtttaagtgaattgcccaaggtcactgagaaactacacggcataactgagatttaagcccagatattctatctttcaattcagtgcactttctacttgtggggacaataaatcagatttctctgggccagtgcaaatttcgcatatcaagtcacagtctccccattactgcactcatatttgttgaaacaagtgttgtttttttgttttgtttgtttgtttgtttttgtttttgtttgagatggagtctcgctctgtcacccaggctgcagtacaatggtgtgatctcggctcactgtaacctccacctcccgggttcaagtgattctcctgcctcagcctccctaccagctgggattacaggcacctgccaccaagcccaggtaatttttgtatttttagtagagatgggatttcaccatgttggccaggctggtctcgaactcctgacctcagatgatacacctgcctcggcctcccaaagtgctgggattacaggcgtgagccaacatgcccgaccaagagttggtttttaaattagaaaacacagcattataactaaaactatgggagggcttccaaaggaggaatcaggtcagatactcaagctaaaactctaatttcagtgcagtggaagaatggctgtgtcttatcccttcccactctacaactaaagagtgaaaaagagagaagtttgataaataaaatggatcaggaaggttgcaaggacagaggtaacattgcttaagggactgtgtcacagatcttgcttaccctcaatttatcctatataaaattcagtaatagtagctataatacagtgttttgtactaataaaataagacaatcaccttaaaacaatcaataaaggtagtttgagtgttagaagaataaagaaacccttgcacatgacccaggctctaacttcagagaaaaaagaagccataagatatgaacccccttaactccctaccatgaaatctttaaactgacctgtatctgatggcccatttccttcccttttgctcttttcttttctatggaaaatccctcttctgctgtactgccttcctagaaacctttctccagttccagtcatcaaccttttttgttcttcagatcccttcctatcagcacataaacatggttattcaaagcattactcaactcattaccctgtcagctaactctcctatttctctcctctccttcataaactaaagaactatctgtatctaccatctctccgttaattcctacacctcaattctcaatctactgcgttctggctttctgcctccccagtccaccaaaactactcttaccaatagacaggatgactatataatgtattgtccaaactggaatttttgaaaatactatttaagtccttctcccctgcccattgtgctatggcgtaaaaccctgttcatttccttcacactctggaattatatatttactagtttacttcgcactgtctgtcttctagtttactgccaaacttcggggatattgaagtttagttgccctggtgcctggcattcccagcacctggcataatgttggcacttagcaggagctcagtaattcttttttttttttacacgcaatacttttattttagacatgcaaggaaagctgtttcagaatctactaatttaaagcaagcagctgtatatagatagcaaaagaagcaacattttgttacagcttagcaagaactttttagagagctatgtctgaagtctgttctgcaatatctgttgcttaataataactctttcaaagcattaatgttgagtttatatagttcaaaaattctaatattcagttttaacacctaaatacttatattttactagtgatggcattctaatgtattaagtcctcatttaaataattaatactttgttaactgtggcattatatttctgaattttaaaacctttaatattggtaactattgcatattcttttaataaaacagtaattctttattggatgaatggatacatgaataagcagatgaaaaaataaacaaataccatgcagaatacttttggaaaatagtggcataaatactacaaaattgagaatactatagctggatctttgtcctctatttaaaaaatcagcaacagaatctctgagatgaaggttgaacaaccaaaaaaggtcagagttaacaccaggaaaaaggtaagaacgagtggagaaaagtcgagagaactggtgaattcaaaccatttcctccattcttctcctttgatacttgctatctgtataaccctgttttaattccatatcttgcaccagagaaaattacactaatgaacaggtaaaacaatctttctttctttcttttcttttttttttttttttttcagatggagttgcccaggctggagtgcaatggcgcaatctcggctcactgcaacctccacctcctggattcaagtgattctcctgcctcagcctcctgagtagctgagattacaagcttgtgccaccatgcccagccaattttgtgtgtgtgtgtttttttggtttttgttttttttgttttttttttgtatttttagtagagacggggtttcaccatgttggtcaggctggtcttgaactcctgacctcaggtgatccacctgcctcagtctcccaaagtgctgggattacaggcatgagccactgagcccagcccaatctttctggttaaggaacaccattctgtctgatagagagaggagacctttgaatgtggaagtcaaacactcagaaggattatcaacagcagtgctatttttgctatagtcaggttgttgcaatgaataccaaagaaagatttattccataacaggaatgacactttggacagctatcaaataacatttacttaattatctttttaacagtcactttttaaagattaactttaagacaaatatttaactagatagatattctcctatcagttatacatcaatcacatgaatctgtctgtaataaacaagcaaccaaataaggtgagagcttctactgagaaaaggaaaagtgggagtggaagatggagaaaggtgagagaactgtgagtttttattattgtatatctcattattgaaaagctacacattggacacatacacaaaaaagaaaaagtctttcacctctgagaataaatattccgagcacgctctgtgtcccaatttcctttttttttttgagacaaagtctctctctgttgcccaggccagagtgcagtgtggtgtaattgcctcactgcaacccccacctcctgggttcaagcgattctcctgcctcagcctcccaagcagctgggactacatgcatgtgccaccatgcctggctaatttttttgtatttttagtagaaacagggtttcaccatgttggccaggctggtctcgaactcctgacctcaagtaatctacccacctcggcctcccaaagtgctaggattataggcgtgagccactgcgcctggcccccagcttcctagttttggggcctacatccccgaatagcacagggctgtaaacaagatttgttctgccccagaatgacagcccctgtgcctttcctatttaatattacaaataatcacaaaccatgtccatggtatttggtagttgcaaagggtctcaaataggagaaaatttacttgcaaatatagcctctgaaagctgcatgtcctgtctttacaatgccatctgtcattgtatccagggaagaggggtacaaattgggagaagagctggtcccagaagtctctgaggcatgcctcctgtgttgtagagaacatttccttctaggacagaaaccacgctaacctctcttctaggacagtgccacaatacaattatttggtaagatagcaatcatatagcagtcatgccaattttcctgcatcagttaaggtacttttgagtgaagcaacaaaacccctgacgctaactggctaaaacaatcaaggtgattcatcagctcatgtatttgaaaagtcgaaaggcagggcaagctcacacattttggaaagtccaaaggcagagctccacctctctttctctgtgtttccctgggctttgcccttctttgtgagttgactctgtcctcaaactggcctccctcttagttgcaagtgactgataggagcaacactagttactaacgtcttcattcccattaaaggggagaaaactcttacttcactcagccattaaactgaagttcagcactttgttctgatgaagccatcccagaaccaatcatgatggcaagagaggggattagaaccatccttggatacaggcaagagtcaatccatcctacctatgatgcatggctgcaactgaatgcaggaggagggtgtgatgcaggagaggcaccactatgtatgtattcagcctctgcattgatacccttgacccccgtgacttaatactacacacacacacacacaactctgagaaacagattctgtgtttttagccattatctctctccctgccatctttacctcctgctttatcaaaacttttggcagggaaagcaaggcaggaaagaagatgaggaaagataagacagagaagatataatgtgtcctttattttagtagtagaaggactctggaaacgattgaatgattcaatctgcatagctactcaaggtttgcagctgtggccagatctagtcctgttgacaaccagatatacatagtgatcaagataaattctattttgggaaattccagaagagaaagtaacataggtagattacccagaggttctatacaagtctggacaattctccttcaaacaaaatactaccctttgggttagtgatgcacccttagtaattaagtaaaggaacaatctaaaaacataaaaaaatttgtgcatagttattcacgatagcagtaaaaaaattgaaaacaagttaaatattcatctgtaggtgaagtgttacatagattatgatacatccattaaatggaacattaggcaacaatattaaataatggttctgaaggctctgtaataacatggaataatatttataatttattactaaataaaaaagcagaatttgacatataattgtctaaaatatatatatcaggtataaaaagagacaggtataaaatatatacatcaggtacaaagagagactggaaagaaatgtaccaaataatgacctaaattttaattttgtaactgaaaaacattagaaagcactattaattacagatatctacttagcatttgcctctgtgctggtgaaatcatagttacaattagctggtctgttctctgccccaacagcactccatcatgcattcaacaaacaattattgagcacctgttatgtactaggcacctgggatctgtcaatgaactcaatgacttgggttctgcccctatccttataacccagtgaagaacacagataagcaaataatttattgcaaattaggaaaacatgttataaaggtaatcaacagaagatcataagaggaggggtaacctgcttcaaaagggggtcagagaggattctgaggaggtgatatctaagttaagacttgaggaggagagaaggggccaggaactacaagtgcaatttaagcagagaacccaggatgagagtttggtacaaaggaggctggtgtggctgaagcacagtgcaagaaaagaagagggtgtattagtttgttttcacactgctggtaaagacatacccgagactgggaagaaaaagggattttattggacttacagttccacctggctgtggatgactcagaatcatggtgggaggcaaaagtcacttcttacatggcggcagcaagagaaaatgagagaagaagcaaaagtggaaacccctgataaacccatcagatctcgtgagacttattcactatcacgagaatagcatgggaaagactggcccacatgattcaattacctccccctgggtctctcccaaaacacataggaattctgggcgatacaattcaagttgagatttgggtggggacacagaggggtaagcagggggccagattatacaaagccttgataagaattttggattttattccaagtgcaacatgaagtcactaaagtgttgtgaagagaaaaaacatggctcagttagccttttaataagatcactctagttccgttgtgaagaatgaattggtaatgggtgtgaggcaagataagaagtagaaagacctgtcaggtctttgtagaagatggtgaactgggctggggcagtggctaacacctgtaatcccagcactttgggaggccaaggcaggtggatcacctgaggtcaggagttcaagaccagcctggccaacgtggtgaaaccccatctctactaaaaatacaaaaattgctgggcgttgtggcacgtgcctgtaatcccagttccttgggaggctgaggcaggagaatcacttgaacctgggaggtggaggttgcagtaagccaaaatcacaccattgcactccagcctgggcaacagaacaagactctctctccaaaaaaaaaaaaaaaaaaaaaaaaagatagtgaactagattaaggtagtagaaatgaagccaaagtgggaggatcacttgaggccaagagttcaagaccagcctgggcaatatagcaagctcctgactctcaaaaaaattattttaaaaattaggctggcggtgcacatctgtagtccctctatttctcacctttttttatgatattgtcacattaattttgtaactgaaaaaattagaaagcattattaattagattacttagcatttgcctctgtgctaactcctgggctcaagtgaccctcgcacctcagcctcagggctgcagtgagctatgtcacaccactgcactccagcctgggaaacagagcaagacccaatctcaaaaaaaaaaaaaatagaccagaggacacggcagggtgcggggaaaatgagacatcagcagtggtgcccagaagactggttttagctcctgggtgtagcagtagcatttacgggaaggggaaagggaagaaaaaatagatttgggggataaaatgatgaatttagtaaatttaaataacatgagactgcaccatataatttgcttatagaatctctctctccaggaagacctttaaagatgaggaatatatgtttcacctttgaagtctcaacaccctgaacaatacaacatgttgcagactaggtatttagtgtttgttaaatgaacatcacaactttgcaagtggttcattcattccagtataataagattccagttattgtgaaaagccatttaaactgttttccttaccaaggaaaagttgatagatgagtaattattctttaacttaaaaagagaatgaaaaagtatgtgatttttttaaaattattttttgtttgtttagttttctgtaaagtaaaatagcagttaaaagctaaaatgcgtgtatttacattcttaggcctgctactgaccttcttcaagtgattttacctcccaacgtttcagtttctccatttgcagaagggagataatggtggttgccttatctcacaaggatgtcatgaaaataagtcagataaattgctttgccctccttggagaggggctctagaaagtaagcattattagatatgatgatgaatacccacaacttcaaagatatttttaaattgccccccctccgcccccaagtctttgaacatgttaagcctatgaatagcactggggtaggtgtttatatatttctggcaagctttcacctcttgttaaagcagtaaatggtctttgaacaaacgtatttctcattctttgataactatgcttccttgtttgtacacttgaaagatgattataatctggcatatgaggtcaagttgaactccttggtgccattacagttcaaatgtagctttaattgagtttttcttccaaggttgaaaataagtcacccagttcactttagcaaactactcgcattttttaaaaagattgtggggaatgtaactgtttttgcaactgatatgtataatgtttttcattttagttataatatcctcattgatcatacaaaaaagtcagtatttgtatttcttcattattgcatttttctgttttccttaaattgtttttaataactataattatgccttttaacacttatatagacagccatagtacacacataaatatcaccaaagtgaaaacctagagccccaagacaaaaaaaaaaaaaaaaatgatagtcaaacatcatctagagaaagattctagctgcaggtgtgcatcaagttcataattggtgttattttaaaaattcacaaaccattagcacttccacccttctccatatatctcttaactatatacccaagtcaaaaccacttcctgccagagtaactacaacatacccatcagagcgctgtaaaatcattacttgcaaagtaaagagtaagacagacttctcctctcattaataataccagttgctgtcatatatattactcatatattctccccacaaccacccttcaagggaagtcttagtacatccggttgacacatgtggaatgtaaagttgggtgacttatgctagattccctcagctaggttagaacagggtaaaagtacaggaccacaataatatccttatttcaatgtcttcctgtttcctttttatatcaaggaagaaatgagaatttgaggcaacacaaatgaagaccatatatactttgatacctacctaggaggggagatacaaaccagagtaaaggaaaaatatgggaaaagttgcctcatttccacctagtgatggtggaacccttggaaccctcttcacatcccataacgactgacagaatggacactgaaaaacaggcccacccctcaggcagaaccactggaagaaataccctaacccctatacgtgaaggattagcactactattttcagaatattattaaaatttaattttgaaacttctctttagtgatattcccagaaacctataacagataccaccagtgtaaactcctctcaaatacatttattttgggtaggcctcaaactggtaggatggtccaaaccctcacccttctagagaaagcactcaggaatgcttaaatttgcctaggccaaaggtcgcaaattaatagcctataatagaccagattttatctcaaaacgtttttttattggtgcattgcaatgacttcagctatcaacaacctaagctaggaggtccccaggccatccttacatctgacaagctgcctacaaatttaggggttcccactaccccttcaagtttcataattcagtagaatgacttagagaactcaggaaagtgttatttcggttttattacagttttatcatagcaaaaggatgtttattatagttattattatggttttattatagcaaaaggattcaaatcaaaaccagccaaagggagagacacatagagtgaggtctgggagggtcccagaaagaaggttccattgtccctctcctcatgtcctcagggacacattttcctcctagcacactgagtactgccaaccacggacgttcatccaagcttcagtgtgtccagagtttttattggggcttcattacaggcatgattggatgaatcactagtcataaggctcagacatgtggctccaagtctctcaagaggtcgggctagtatcatggggcccaaagccccaacactctaatcacatggctgaccaacccccagtcatgagtcatctcgttagtgtaaactattgggtctagtccaagaggcctaccaagaaaagacactcccaccattcttggtgaattccaagggtttagaggctacttcccagggttcaggaacaaaagccatccaaattctttaccatgcacttatataatatttaaattttatttcaatttagctaccaacattctataatcagtggtgttgacataaaaatctgaatttttgtcttctcttgcaatactgacaattttaggctcaatttctgtaagattgctgcctccttaaaaagggaagctcattctccctaccatctctatagtctccattttcttattcccagtgtgattcacttctttgtttcctttctgtccactgcagacatttaaatttgcatatcctgggctaattcttgggtattttcgctgtttttacttccatcacatattattaccttaaaagaatgaacatgaaggaatgacagttaccttttgtcacttcattctcatcttatttaaaaccactcctcccttacactttgtatgacggtgggtgcatgtgtacacacgcttgtgcctgtgccatctatttgtctcttaagtctcgagccaggctaacatggaatttttgactgcagaaccaggacaagctgaattaaaactcaatgtcatcctcagagtcaaaacccataaccaactccagaccttacaaaggaagcccctcattctgaaggacaaaagaaaaagcatgtttctcagtatttttaaagctaatgcttccttcatacgcataaaattctcacatccttcatgtgaaatacaacctaagtaacaaaataaagagaacaagtatcgtcatttgcaaacttcatataccctttctctcactatacccctttgagaatcactggtttaaataatataaaaggcatgaaacaagccctaagtacctcaggaaccatgtggacatctgtagtctctctcagatacagctgtcacatagaccttgaagtacagtcaaccctcaatattcatagattctgtatttgtggattcacctagtcaccgaaattgtttataatctcaaaagcaatacctgcagtgctttcatagtcattcatgggcatgtgcagagccctgaaaagtttgatttccccaacacataggttctcttttgcctttgtagtccaaaaaggacactataaacaagtgtcctatttctggtctatttaatggcaagtttttcacatttgtatgcttttagttggtgactgtgctgtttaaaatgacccccaatcatagtgcttaagtgctgtctagcgttcctaagcacaagaaagctgtgatgtgtcttacagaaaaaaaatacttgtgttagccttcattcaggcttaagtgatagtgttgttgaatatgagttcagtgctaatgaatcaacaacatactttaggatgtctttaacagaaacacacacaagattatgtatcgattctttgacaaaaatgttgtgaccgaatgttcccaggaacctaatcccgtaattcctctgggagcaatggttcagtattcactaatccagtgttcacagaggcttcacagaatgtaactactgcaaataactagaatcaactgtacttgtaaaaaagtgaaacacacacagcacaaaatcacatcgaagagtattagggcgggagtggatgtggggtggaaaccaaggttacaaccattaaggaggttattttattttaaaccagaaagtgacgatggagttaatgctaaccatctgccccaggttaaccaacaaagacttagggtgcaatacagtgaacagaacactggactagaacttgggaagcctagcttctggtcacaactctgcaaaaaaattaacttaggcaagtaaataacttaggcaagtaactaaaacccctctccgcagcagtttcttcatctgctagagtcactcaaatcggtggcagtaagaagtcacttttgcaataattattatgtacagaaagttttcacataaattatctcactggatgacctgtatggtcatccaggatgactggccgtctttactctagaattatataacttaatcattttaccaaaaagaaacaatatatttaatgtttataatactaagaattgtcctttggactgtttgtaatagacatgtcagagggacgacttcaaatatgagctagaaaacaactatggacttatttttaaattgaatgtattaaatcactgttttctttttaaaaatgaaagaaaaacattcccagtctgtggccattcttgcttcacggccctgcaccaccacaaatgttgtaaatgtggagaagcaaaagtaccactagatggagtaagaacaaaagacatgcacttgtctgtagttcaaggagtccccgcccttgcaaaagggatcttagtccccgcacggtggctcacgcctgtaatcccagcactttgggaggcagaagcgggcggatcacctgaggtcaggagttcgaggccagcctgcccaactttactgaaaatacaaaaaaatcagccgggtatggtggtgtgtgcctgtaaacccagctacttgggaggctgagagaaaatcgctagaaaccgaggaggcagaggttgcagtgagccaagatggggacactgcactccagctctgggtgacagagtgggactccgtctcaaaagaaagagaagaaaaagcgatcttagatcaccttgagtaaactgaggcttactgaagctgagctacttcctcaagactctagacaagttcttggcaaaatcattccttacttttccacaaaaccatgctgataggaaaaatatttttccttatttagagaacattaccagcaacagtggactctagaggtttttttacatttcttaattctaatagtgctaagaaatgtatctgctagacaattccaggggacctacttaggtaataggttaaaaagctacaaatatacatgttcataaatttactgacatggtcttgacttctgactttcaatcatcaggattcaggctatcaccctaaaggtgggcctttatatacacacccctggctgctctctctcttggcaactacccccagatgatcctaaggaattgaaggtatggatttgggacggaattaccttgtcgtgataagtgggcagaatggcctgtttgtttctttcaacctagtgggccattagcttattttcttaaaggaaatcagagccaattcttgtgggagactgccggctgggagggttgggggtggggggtgtggaataaatttcttttccgtctttcattatgcctagtgttccgttattggaacgctaagcttgtgggggttatatcctactgctcaaggtcatcgccaaggtctaatttttcaaaaaagaaacttctaacctctggcataaaccgatgaccattaaaggaacacaatttccaatgttcatttagatcttctaattaaatattcattaaatgttaaatgatctctcaaaaaaaaatgactgttctcccacaccccgttgaggggactggtcgagatctaccttgggagaagcaaaaacctcaacaaaatctgcagagcaggaactaagttgtaatacaaccataaaaggcaacaaaaagcggaagacgggagaacccacgcaggaacggctccaggcaaccccggctcactgcccattcattttggccgactttggaggtgccttcacgtctcctgccaatttgcagcacactggcccagtcagtcaggtttgggggttcacaagcccccattgccggcgaggggtgacggatgcgcacgatcggcgttccccccaccaacaggaaagcgaactgcatgtgtgagccgagtcctgggtgcacgtcccacagctcagggaatcgcgccgcgcgcggggactcgctccgttcctcttcctgcggcctgaaaggcctgaacctcgccctcgcccccgagagacccgcggctgacagagcccaactcttcgcggtggcagtgggtgcctccggagaagccccgggccgaccgcggcctccaggcggggttcgggggctgggcaggcgacccgccgcaggtccccgggaggggcgaacgggccagcagctgacattttttgtttgctctagaatgaacggtggaaggcggcaggccgaggcttttccgcccgctgaaagtcagcgagaaaaacagcgcgcggggagcaaaagcacggcgcctacgcccttctcagttagggttagacaaaaaatggccaccacccctcccaggcccaccctccgcaacccggtgcgctgccgggcgagtcggcttataaagggagcggccgccgaccgcacggattggccaagctgactctcgcggctctcgtgagagtcactctctcgggcgggctggttggggggaacgggaaattaaagttccatttccggccatgaggaaggacgttgcccttccgcacgtccgggaaaggctttgcgtctttacttccgaccttctttaaaggtgaaactaacttgaggtatcagagggccttttttctatcctctgcagaccagacgcggttcacctcgactaccttaaaaatggaattcacaggaagattttagggcctaagacacagaacactaattcctagttttgatcatcacattttttggagaactttgtgaaaatagattcccaggcagcactgactacagcagaatcttgtctcggctcagtgggatgcgtccgagttcctaccctgcccccttctccttagaatgccttctccagcctctccttgagcagaggatggctttaatcaagtgtaactactacattattaatcttaaggactgaatctcccttttattaggaaagaaaggcgtttcaatcattgactttgctttaaagtagtgctgtgtcttgatgaggtaaaaagaggggagtaatccaccataaattgtaacgatttttttttttgagacggagtcttgctctttcgcccaggctggatggagtctagtggcgtgatctcggctcactgcaacctctgcctcccgggttcaagcgattctcgtgtctcagcctcctgagtagctgggattacaggcgcctgccaccacgcccagctagtttttgtgtttttagtagagacgggggtttcaccatgttgcccaggctggtctcgaacgccagggctcaagtgatccacccgcttcggcctcccaaagtgctgggattacaggtatgagccaccgcacccggccgcgaatttttataatggccagtatagtgcagttttacatataaatgacaggatgatcttaaaagttttactcgtattcagttagataaactccgtggagttgtcgctgtcggtcctcgatctgaaagaaaagtaaaatatctccctctccatctctctccctccttctctctctcccatcccctttttctttcatagcatctgccaggttgtaaagttttttacggacagaatctgactcctgtttttagcactattgcacttagcacagtaccttacatagagtagatgctaaatgctttgagttatatgtcaacactaccaccattctcttagcatcccacattatctcaaacccttctttccccttcatatctaagtaggcactaaatcttgtcagttttcataatttctttttttaaattcctattgcttataatcttgagtacaagacttggcactttatatgtggactagtaactttctaactgatcaccaaatctccagggccttcctcattcaatttattctccaaactatcacattcatcataacatagtttccttatggctcctgcttttaaatctttaatttctctcctttgcatattggatatttagcactttaagcctttcagtccctggccttcacttaaccttgctagtcatagcgcttgttctgctctatatgagctcttgacttgaacaaaatcagtctaaacttaggcgtggtggtgcatacctgtggattcagttacttgggaggctgagggcagagcccaggagttggaggctgcagtgagctatgattgcactactgcactccagcctgggacacagggcaagactctgcctctaaaactaaataaatgaataaatacatacataaacaaaaattttaaaaacaaaatcagtctattaaacatgccctgaatatgctttgttcattctcatctttagcaacttgttcattttagtatgcttgcctggatatctgcgctccatcccaatgccaccccttccatgatggcatacctctgctatggagtctcgttcctcaccacagcaaccttctttccctaaacttcaataagcttaaatcttatcactcatttggcacatagcatattgtaccacaaatgctctcttccaagggaaatataagctcaccaacgtcaagttatagaagaaacactatgggaaacattattttaacttggttctactcaatagacatctgttcttgagcttcaccattattatcccccaaacccattatagaaatacaacagaaatattggcatcccaataggtgaagtattttctcttctcccagaaacatataatatccaaagttttctgtcacatatactcaaaacattttcttccaaccattttatctgtatttcagaagcatctttggtgtactatgttgggtccaacttctttaaattctgcagcagtgatccacatgtcctggaaggcagacaaggatgcaagaatagaacctcccatccacactgatattttcctttctggaggagctataacttgcacagcggtgttggcaggagccacctttgctatatccttaactaaccgcttgtctaaaccagggaaagaggttgatcccccggcaaggataatattggaaaagaaggaattcctcaggcctgtatcacatttcattatgctgctgaagcatatcttatcaatgccaggggcctcaaggttcatatgacacggagagaagagggcctctggacaagaaaagagctggtcatggagctggatgaccttcccatcaggtagttggtaaactttctctagacaatcgggtttcttggccatttcctcttcgtagttcattgccacataacaaaagctctccttgatgtcttcaacaatctttctgtctgaagcactgagcaacatgataccatggttcttcattagcaccatgaggtagttggtgaggtcaaggcctgccagatccagttgctgcacaccatgaggcagacagtaaccctcaaagatgggcacactctgggtaaccccagcacctgaattcagcacaaggccagtagtgaagccagcagcaaagagagccagcacagcctggatggacatatagaaggcaggaacacccagatgctcaaaaaacatttccgtgatctgttgccggttggccagtgggttcagcgctggctcagtaatcaagactgggccatcacacggcttcagctttaggttatagtcatagatatgcttccacatgatctccatgtcctcccatgaagtaatgagaccacgctccactgggtaactgtaaggaaagcaataagatcaatgacagctttttatttttctagtttctattgtcttcgaccctcagttaattccccgcgtttattaccaatatccctttatgggcaataactgccacagcctctcacagcaggtaagtgtcagccaaaaatagcacagctacttacctctgcaatttttttttttttttttggagacagagtctcgctctgtcacccaggctggagtgcagtggcgcgatctcagctcactgcaagctccgcctcccgggttcacgccattctcctgcctcagtctcctgagtagctgggactacaggcgcgcgccaccacgcccggctaatttttttgtatttttagtagagacggggtttcaccgtgttagccacgatggtctcgaactcctgacctcgtgatccgccctgctcggcctcccaaagtgctaggattacaggcgtgagccaccgcgcccggcctacctctgcgatttttgttgctttccattttctctgtcctttggaaccttgtgacttttaaaaaattgggaaatgtccacattatagtatagtttaaatgtcaattgaagagaataacccaagtgacaaaagggaccatgagttaatattcttaaatgaattcgttcgataactttatacgttttaatacatttgtatagccacagagagcaaaatgttcagtttttagatgtgtggtacccttggagatttgtggcccgtgcgtttgtagtaattccagctggatggggctttccagctcccggctttcttattctttctgtccccattgcgcacctcctttggggtcctttcctgccccccgacaacacccccagtccccccacccccagccaccccagccccaccccccaacctccccagccccaccctaccccacccccaccccacccaccctccccagccccagcagcctgctgggagaaggaggtacctgatgaacagcgagctcctccagtcctgagcttggtcgcccacgcagagttctagcccgccctgggccgcgcggctctggcccttggcgcggccgataatgttcgggtagataaactggggctcccggcacccagccacgcccgccttgatcattcccgagccgttgtcgatcaccaccggtagctggcagtggttcatgccgccgctgctgccgccgcctcctgtctctgagccgctctagctacgggctcggccggggccgagtgcctggaacgccgcgtcacagaggccccggcacggccgggtgaggccagagtcctgggggcgcaggcagggggtcggcagggccccaggcggaaggactcgctggacgcaccgtgctcctcatgttaccgcccgctattgcttctcgcaggaattgggccaccccaacacctggaatcccggaatcccagtatcaggaaaacccgactttcgcatcaaaagattcaactctaacccttcacaagtgcatttctcaaatacccagaagagctataacagcagttttattttccaaagccacggaattctggttaactggtggcggttccggggagttctagaattcgcccttgaaactggggaaaaatgagacttaagaggagaaagttgttgcaggaagggaggcagtgtctgcttctgaaatgttaaacttctaaaataaggagaaaaatgctggaatttaaatgagttttaagtacgtttattattgtttctgtaccttgggcaatgctttgttgtgtttcttcctgtgatttccaagcaaaatgtacgcaattaaaacaaaatagtagttcctagcttaaatatgtaaataaatataaatttatatatatttatataaatatatataaatttaaatataaaatattaaaaaatatataaatttatataatttatataaatatatgttatattatataaatatatttatatatttataaaatatatatttatatatttaagcaaggatataaatcgaaatatatatatttatatttattatatgtataaatataaatatataaaaatttatatttatatttattatatgtataaatataaatatataaaaatttatatttatatatcataaatataaatatataaaaatttatatttatatatcataaatataaatatataaaaatttatatttatatatcataaatataaatatataaaaatttatatttatatatcataaatatataaaaatttatatttatatatcataaatatataaaaatttatatttatatatcatatataaaaatttatatttatatatcatatataaaaatttatatttagatatcatatataaaaatttatatttagatatcatatataaaaatttatatttagatatcatatataaaaatttatatttagatatcatatataaaaatttatatttagatatcatatataaaaatttatatttagatatcataaataaaaatttatatttagatatcataaataaaaatttatatttagatatcataaataaaaatttatatttagatatcataaataaaaatttatatttagatatcataaataaaaatttatatttatatatcataaatatataaaaatttatatttatatatcataaatatataaaaatttatatttatatatcataaatatataaaaatttatatttatatatcataaatatataaaaatttatatttatatatcataaatatataaaaatttatatttatatatcataaatatataaaaatttatatttatatatcataaatatataaaaaattatatttatatatcataaatatataaaaaattatatttatatatcataaatatataaaaaattatatttatatatcataaatatataaaaaattatatttatatatcataaatatataaaaaattatgtttatatataataaatatataaaaaattatgtttatatataataaatataaaaatttgtttatatataataaatataaaaatttatgtttatatataataaatatataaaaatttatgtttatatataataaatatataaaaatttgtttatatataataaatatataaaaatttatgtttatatataataaatatataaaaatttatgtttatatataataaatatataaaaatttatatttatatataataaatataaatatatatatttcgatttctatccttctggtgtaatctgcaagcctcattcgctactcttgatttttaggctgaaggacgtgcctgtctttttgcaggaaaagtgaagtttatcaggtcatatgaaattcaagtttggaaaaatttgaaagtacattgcatgtcaataaacgcatcttggtgtctgattctgcatacatctgtagagaatttgaaaacaagcagtcaatttagaacttctgcttggtcttcggaagcaaaaagaggaaattcaaaagtaattttacacgtccttccaccagaagctgaaaggatggctttttcgcggctgaataacgaaagccccctgcttcgccccggactctgagcagctcaacctgcggaaaggatgtgtaataaaacgcctttccagggagacaaaaaaaaaaaaggccacccaaaggaagggcaactcgggagtgcctggtttctactgcggtacccgggcactttggaagaaagtgcgtgcagattcaagcttttgaaatggtttcagctctgttcaattgggcataggctatttttccttttctgtttttttctttaaatacattatattcattcctctcaatttgataataatcacttgagaattgcgaattgacacttacatatcaaggactttacaaaaccctctccaaagtggggtttccgtagtgtagtggttatcacgttcgcctaacacgcgaaaggtccccggttcgaaaccgggcggaaacacactaaaaaatccctttttttttttttttttttttccttcgcttggaagaaagcgtgagatcacgctttgttttcttttgttgtttgttttgtttttttttctgagggaagccttagcttaatgtatgccggtccttcaaaagacatgatagcaatttgagagtctgaactgtaagtttttgttactttattcgttcaccaaatgtttttatggaagccttgccacgtggaacatgtgtcccgggttttaaaaaatgaatttgactcaccagctaacactgaaaaaataatgtacagcctagaaggaaagatcaaagtgtaaaagtggttagtcctgtcgcctcctgagcatttttgtattatatcacttggtttttcgtctgaagtggctgtaaataatcgtattaaaaatcttctggtccagacgcaggaaaaccttttccggtataaagcccaccttcctctaatgttgcgcatgcccactgtgcccagctgctccgctttcgtgcatcccagacttctgtcaccaggtaagggcatcttggaagctgagctacagttggctggggcacaaaaaaaccagggggtgccaagagttttcaggtacgtaagcgggaaaggggtgccaagtctcagctaaaaaatcccctatggcagagatccgagtacacatgcagcagtttccaccggtggggccccgaggaaggggaggatgatgggagaagacaagcaactacaagcccccgcacgcagtgcgcagctggcttcaggagagaggcccgcggtgctgtgctgccgggcctcggcgcagagccccggcagagcgccagacgctgactgccggcaccagaatgctcgcgatgaggaagacaggcggagcgctgcgagctagcgagccctcagctctcgtatccatgacgcctgctgcttcgggggacccctggcatgctggggagtgggtctctgtggtacatcctgtaccgccctggccggcgccggacccccatggccccagaacctcccgcactgccacgggaagacagagccggacgtgacgccaccgtggaaggaagggaggggcggagcgtggctcggtgacgtcctcccaagatggcggagacagagtgaagaaactgtgttccccccttgggttgctatcggtgagttcctacttcacccccagcccgccatcccggtctctctagagcctgggccatcagagggcaggctccttggagttccagcacgggtcggggcgcaggtggaaggcttgggctaggcagccccggggtggcctgggccacaacctctgctgtggaaattcgcgggagtgggagctgggcagagggcagggcggcagaagccgaggagggactggctttggttgtcactctcggatgccgcctcgcgtagagagtgggaagggagaaggtgtggcctccttagcgcgagtgatagaacctttgacagcaagccatggccgggcgcattcccggctttctgggcagccacctctcgttttggagaaactgcactggggaaactaacaggttttggtgacttgagagcagtttttaaaaactcgtactgttctgcccctatctgtcccaagagatcatgtcttagtggtttaaaaaatttttttgtaacataagtatgtctactgagcttgaaaatctgagggttcaacagatgtgaaagcgtcaggttttgctgtgctttttgcaggtggtagaagtgttgccattcaccgtcacttattgatgtgtccaaaggattgtgttagttgatcaaggtaaccaaagatagaaaggcactcatcccttcattcttaaccatgtatgtttgataaggattttcaagggggctaaaattgtttaagttatgtcctctgtcccttccctcactgaacgttgatgagaacttacggttactgatttactgtttctttttgtcttttagatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacaggtaaagtacacattttattttcagttataaaagctagtcagtagtcttcacagcaaaagtagatttgtattttttccattcattctctgaactcaaattcttcacctatttatgcacacaatgtttgtttttataaagaaatcagtatcactgatttaggatgagcaggcaatatttttcataagcacagataataaacagtaagatttctgacacgtttatttactgaaacaaagcctgtgatttcacttatgtaaacttgaacattaaacacaatgaatttattttattttatttttgagacgggctcaccgtcacccaggctggagtgcagtggggcaatctcggctcactgcaacctctgcctcccgggttcaagcgattctcccacctcagcctccctagtaactgggactacaggtgtgcactaccacacctggctaatttttgtattttttggtagagacagggtttcaccatgctggccaggctgcaaacaaaaaattctaagttacttccagtttcccattgctttttggtccttgaattcctctggtcttctgtctccctcattctgactcctgttatctctattaacctaccagtactaatactgaagtaaggtcagagatgctagaatgattctctaagatgcttactgatgtcactgcattaacaagaagtgggttctgaggaatctgataatgtaggcactgtgtgtctcccctgtataacgaaccatataattagattaatatcaatacatttacagattgtaggggaaaaggtggagggaataaaagcaaagagaaactgattaaattacccctgtcttatttctgtctctcttatgaaagtgaacatgaatagactgttcataatcttctgacacaggaagattataggctttggaattagatctttcctgtcagtcgctatgtctccttgagcatgatgcaatctctctgggcctcagtttccccatctgtcaaaatgagatggtaataactaccttgaggctaaataaggttttacttgatccttattcacttcccactgaacgttaatttctttatttttcttctttaccctctcctccccctttaattccacatttctcggagaaaaaatagaaaaaacaaaaaagaaacacctgaaatactgctgcccactgataacccctgttaaccttttgatatatattaattaattcttttccagatctctgtagagatgtgcatgtatacattaagcaaaatctttccctcccttttatattgtaacttatcatggaaatatacttatttaaaaatctagaatcagggtgctcattaatccttttgacgaggaaacattcttgtgtaagaagtatccagtggggggaggggagggagagaaaagtaaactttcatgctattttggaattatttttaaattttggtataatgaaatcttcaagtgagttctttataagttgattaaaggaaaagagcagtgtgaattttggctggcctgcaatttaatggtttccctttctctcaattaactatgcaaaacaaaaaaatcttcatttgaatacacggtagagcacttttctttgagacttcatgcaaagaaccaatgtgaagaacagccaggtgttttgttcagtctcttttggtacatatctttcctggagactggggagctaattcctcgagttcagctagaaatgtaagagaggatttataccaaaatagaaaggcttacaacttagtgattaagaaaacaggtagaatatattaagttggctcaggggccagattaccttggtcaaatcttggttctaacattctgtgctcttggacaggttactttatttctttggacttctgatttttcacttgtgtgtaaaatgaggattataatagatttcataggcatgtcctgaggataatcttataaagcatttaggcatgtacctggcaatatgtaattaaatgaccttcagtgactgttcagaggatgttatctaatacttgtaaacaaaagcaaatctgttattgaagtattgattggtgctcttaactgtgactgagattatagccatctatgaaatagtttgtatgaattaccatttcaatgttgaacaaatttttttttttttttttttttttttttgagatggagtctcactctgtcacccaggctggagtgcaatggcgtgatctcggctcactgcaacctccacctcccaggttcaagggattctcctgcctcagcctcccgagtagctggaattacaggcacccgccatcatgcccagctaatttttgtattttgtagatacggggttttaccatgttggccaggctggtcttgaactcctgacctcaggtgatgcgcccaccttggccttacaggcataagcaactgcacccggccttgaacaattaatgtatgacttcctgctaacttatattggtcttaaaggctacctgaccttgttatctgtttggcggtttattttatggagcactaaacacaattagagaccaaaagatcttttttagtggcccagcccaaaagacaatttttagaaagctgttgtgatgctaaattaaataaggggaaacatacaggtggcacttgaggcaaagcaagtttaattagaagatgatgagaacatgggtagagatttgtagatactgtagcatacttttagagatcttagaggttcatgacactagttattttttattttatttcaaattttagtcctttaaaatagtatcaccagcactatatttacattgtcagctatgattaaaacccttttctggcttatacttacaacagagagggaaagagatcatcttcccaaagataaaccatatttagggaaaaaaatcaagtaggaagattatttgagggtaaggggtgtgtgtgtgtgtgtgtgtgtttccatcctcaaatacttataacagtcatgtttttagtgttaacaccaactcaactctaattttacagctaagaaagttgaaccccccaaagatgctgacttaccctaattaagtcagccagtaatgccagagccagtgctagattaatcaaacaacctttcaccacattgtgaacttctgaagggcagagactatttacttattaatatcttagtaccacacatggtagatgcttagtaaacatttgactagaatattgaacaaggtggcttaagtctttctttgtaactctcacatcacgaacactccagctaatttgggttgagtatcaccaaaaaaggtgggagggttgctagagagagtttaacattctaaaaccttgttcctctaagtggattcctctaagcaacattggcatcaccaggaagtgtattaagaaatgcaggctgtgctggtggctcacgcttgtaatcctagcactttgggagcccaaggtgggaggatcacttgaggccaggagttcgagaccagcctgggcagcatagcaagaccctgcctctacaaaaaaaatagccaggcatggtagcacatgcttgtagtcccacttacttgggaagctgacgcaggagcccaggagttgaaggctgcggtgagttatcattataccagtgcactcctgcttgggcaacagaagaataccccatctcaaaacagaaaaaaaatgcagaatctcaggccccatcacagacctactgaatttgaatctacatttaacaagattcccgggtgattcacatgcacagcaaagtttgggaaacataattaaagtccctcacaggggagcaggagaaaatagtaggaaacaagtgtcattagactttccctcttgccaatccagaaaagttggttgctatctgaagaagcctcaggatgaatggaggaggtagtgagttaccatcagctatttttgtgttctagggttttaaaaaaaaagccagaaaatttaacatttaatttttctgcagtggttcactgtcagctgtgaatagccattatctttcatctcttgaagttctgtaaaattggagattttttacctaaacattattctgaatgaatttataaatctatttttctcttagttatgtctttttcagcattctgcttcattaggtctttaaaatacattgaagtatatatgcagctctgtttcgaaagtttttctttgatcagaatattgtcatgtagccttgtttccttgcagttggaatgttaaagaaattcatcaggctgctgactatctcaaagtggaagaggtggtcactaaatgcaaaataaagatggaagattttgcttttattgctaatccttcttctacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagacgggtgtgtggggagatattatttttatactgtgactaatatagtgtatttttatagagagtacttagcacacactacttgtgaccagaatttggtatatttttctattcatcaaagtatttaacagtgttaaactgttgaaaatttatttgtaattgtaaccaagtatttaatggctgtttaagccctaatgcatcaactccttataccattttccctccaaataagtatgttgattctagcttaccaagtatttaacagagacaaagacattaaaactgataaagagaaaatgtaattacaattcaggccaattttcagatattgccaacacttctcattacatacttctagactctgttgacttctgaacatgttcattggaattacacatacagtgttccctaagcttctacagttacctttattttgcatgtcctctgcctggttgtaaagtatgagcacctattggtacgtttacattcgtacttttttcttttttttttctgagacagagtctcactgtgtcgcccaggctggagtacagtggtgcgatctcggctcactgcaagctccgcctcccgggttcaagccattctgctgcctcagcctcccgagtagctgggattacaggtgcctgccaccaagtccggctaatttttttgtatttttagtagagactgggtttcaccatgttagccaggatggtctcgatctcctgaactcgtgatccgcccgcctccgccttccaaagtgctgggattataggcgtgagccaccgagcccagccctagattcgtactttttaaaatgctgtatgtatttatctcgtgaattcagaaacactaatttcttttgattctactggtgttttcagtggtctggaaaagattatatttgttttcagttccaacagttaacattttcttaataacaaagctagtactgttgatgaaatcttatatgacttatgcaaccaaaacactattttcttctaaatataaattttattgttcctttaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggtaaaaaaccaaatgagttgtttgatcttttagtcttttaatcaccatagtcttatgaatagactattatattagaattcaggacagtagaattgtaattgtggttccaccaaacaatgttaacacgttcaaggaaccacaaggaagccacagtggttgataggaaataagcagggggtggggactactaggaaataaggtcagactcgtccagaagtaagatcagaatggtccagaatgcagcttaagaggatcattctgactggtataggattataagagtggaatcagggtaaacaggaatctatagataaaacccaagcaagggtgatggtggttcaggccagggtggcagcagtgaaagaaataagtagtagtagattctggatatattttaaagttagaaataatagaatttgcaaacagattgtatgtgaagtctggaagagagtcaaagatgattctgaggttttgggcctgaacccctataaagatggagctgccattaactgagatagagaaggtttgtgggtagaacagtttaagtggaagtgcaggaatttacgagtacagttctgtgtgtgttaaatttgagatgacttaacacttctgaatagaggtgtgcaatagataattggttatctaagtctgcagttcaggggactggtttgagctgaagataacagtttggcaatcattagcgtttggcagtcatcagcatatgacagtatttaaagctgtaaccctggctaaggtcaccaagagagtgaatgtggacagaagaaatcaaaagacggccctgaggcactctaactttatgagttctgagagatgggtgagaaccagcagaggtaactaggaaggagcagccagtagaggaggaaaaccaggaaagagggctgccctggaatcccaagtgaaggaagttattccagatgggagtggtcaattgtaaaattctgtgatagggagatgaagactgagaactgacgtggatttagtaaagtgggaagtcagcagtgctcttgacaaaagtatcattagtagaggccagtagagaagaaatggaagtagatagaacacttggagtctcaaggttttggtaaaggggagcagagaatggaggagcaagtaaggtcaagggtctttgttttgtttttggtttttttttaatatgggagacatcagtatatttgtataccataatccaatggagtgagaaacatggatgatgtaggactggggaaactgcagaagtgatatcattaagtaggatctcaagtatacaaattggaattgatggattcagatgaactgtcaccctcatgtcatatgaatttttctcagtgaaataggaagcagggatgtcacctgagagttacaatgggcaaggagatgctgatggtttgaggagagagttcacaagtcaaagagtgactagactcatgaaaataattgcctgcagtattaggggcccactgacaaccatataaagatcatggaaaaactttttgaactgatctcagaactaatgttttgataataagaaatatttgtttttggcagtgtttacactgaaacaactactgattttaaatacatagtcttggcctgttaagatgacatgaaataaaatctataaaaaactttatgaattcttgctatatagactgacctccaaattgttttacttatttaactttatttactaacaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtaagtttgacagggagagactgcttaaaataaagttataaataaaagaaaaaggggacttgggccttttagcgaagtagatcggaaactttgtagttagatatctgtttatatttctataagctatgtttatgatttttgcacatatttgttaaatataaaagctgacttattttctagaataatacaaggtgggtgaaataaattatataacttacacattaaaatcagtgagataattttgatattatataaacttgcattgagatgcattttgtgactttataaaaaccttttcagcttcctaaagggtcatctcctatagttagggttggggagtgggtttgggttgaacatggatttttaaacttcttaggacctttcctacacagatattctgggattttcaaataaggtaattcagatgcaaaatagcagtttggaaacaaattgcttttttagggtacattttttaaaagacttccctacatacttttattctcctttattaatatagtagatagcaagaatagaaatgtgggtttatgaattgacatgttcttaatcatataaaaatcaaattccttgcccaaatcatctctattagaagggacattttgaggaataaagttttaatatatgaaaacttatgaacagtatacaataattactaatattcatttacttggatcactgaaaatacctctaaagtacaatatagagagattttaatttaaataatattccagaaaagcttactttagattatttgtaattgataaatattatattggtatagtacaccacttcgctatcttttattttccatctaggtgaaaaaccatacatatgtggtatttgtgggaaaagttttatttcctcaggagagctcaacaaacactttcggtcccatacaggtctgtgtttagggagaacgtattattttttgttctctcttaatttctttttatgtaaaccttgacttttaagccattatggactatatggtatttagtcatactgtacctatagcaatatcttaatgtataaatatcaacttatttgcttattttgttttttttttagttgtttggagtatgaattaaatttgttaaagaattgtgttggttttccaagaaatatgccagataatcaatagtttttaaatgatttggattaaattgcacagatataccaagaaatgaaaaggaataggtaataccaagataacatcagattttcttactaaacagtgtttagtatgcaatttttaggaacaaattttaattttgacatgcttattgtaaaaagtagtttgtaaattgtataaagaaaatattgaatgtaaaaaattttaaaacaaaggaaaatgccactttgaaagagtactgttctgacattctctttttaaaaattccttctcataattcctacctagaataatgtgagtacttaatagagatttagtaagtttttggtgactttatattctgacgcgctttagtttacaccataaagcactgaacagttatttccaaagaagtgtaatattgtagcatgctgtcagtatttttaaggattttctaatttgccaggtacctgagagcagaaaccatgattattacacttattttctcccagctgtatctcttagccagtgtctggcatataactgacactcactaaatgtttcatagaaatacaagagtaggcttttgtttgttttagtttgcagatacatttctgtttatgaaaatgctcaagttttcttgagatacagattttttgtataaaggagtgtctaggttgtatagaatctttcatttcactatattataaccaggtgattaaagtgacaatttgaaaccaaatttaaacactataataatttttgccttgtgttcataaacattgatatttttgtcttagctagcagcttttaaaatattgaaatttaaacttctaatttgtttttcaggagaaagaccatttatctgcgaattatgtggaaattcttacacagatattaaaaatttaaagaagcacaaaacaaaagtccattctggtaaatgcttgtgttttgtttgcttgtttgtttgttttaatttggtgctcatattagtgctattccttaaaatgctgagatgagatttacatttaagcagtttaaattagatgtctatttcaaaaactaggtatatacatgtgaggaaagtagcttttttgcagaaacattcactctggatttttcatattgaatctcttatttaaaaaaaaaaaaaaaaaacttgaaacatttcctcctttgaaaacctgacttaataacagtcccaagcatgaaggaacatataagcaagctatgtgtcactgtttcccatactggagtctggataactcagggtttactatggttattatgaaaaaaaagggggggggggtggtgttatcatgaacactagtccagaaatgtttaagaggaaatagggaaacaggtagccctacattgttataatatataaaaatggaaagccaaacaacaagttttgagtctattggttaaagtgaattcttgaaaaagtttccctgtgcttaccattttattccgtcattattcgacatgacactaggcccttctggtgtgtaaatacttaaacatcgtaagtattaagttagaaacatctaaaaactgcagtaagtcattaatttaaccacttgttaaatttctgtaaagtgtactttcagggaatatgaagttaaacaaggcatagttctggtactcaaagcacttacaacctggtgtgcgagaccagaaacctaaataaataattaaataaactaaataaatagggaaaatgtagggcataatcgacacaaaagtgctaaagaagatactatgtttttctgaggtaagtactaaaaaaaacttaattttaacttgaaggatggagaagagttcaaagatggagatgggaagagaggattcattccgggcagagaacactgtagagagtcagtgggacaagaaggaaaccttagctagttgaagtgaagagtagtttgggaagaatacagataattacaattttacgaaagcagttttgtctgcgtgacaaggacggtgaaaccaaaatcatgtcaacactttagagtaacggaagcatgttaaagccattggaaaatttgaaggcaaaagtacatctttagtcagtgtgctgattgctcccttgagtagagcagaatttctcacctctgaaaatatatgaaagtgccatacatactgttctgaactcacagaataatatgaacaacttattaaaaacattcagtgaatgaaaagagtatttcttatcactgtttaatattttgagggagttaaagaagtataacgacatttactctcaaagaatttacagtctggttgaggattcaaggcatacctgagtagaatgttaaatggcaataagagagatagatgccacaaggcagtatatgaaaattgacaaatgtgtgattaagccgatataacagctcaccctgtttcattcttaatcaagtccatttttttaaatggagttggtgcttgaacttaaccttgaggcccagattgaatttacatagatagtgaggagggcatatgtacaaaagagaaaccgcttgagtaaaggtatggtggttggaatgtaatttctgggaatggtaagtacattagtctacctcaggggtttagttttgttttaaagataatgtagatttttttttccttccattctaggtgcagataaaactctagactccagtgcagaggatcatactttgagtgaacaggattccatacaaaaaagtcctttatcagaaactatggatgtgaagccttctgatatgactttaccattagctcttccacttgggactgaggaccatcacatgcttctgcctgtcacggatactcagtctcctacatcagatacattgttgaggtcaactgtgaatgggtattcagaaccacagttgatttttttacaacaattatactgactttgtaaggaatatggaattgctaagatatcattggtagcaaacatctctggtaaggtgcatatattcatattaaattcccattcatttgagttgtgaccattatttttcattcactgaagtaaaagcacctgatgctgcatcacaactgcaatgtttgtttttatttttggctttatgtctatactccacagagagctttttaagtaatgaattatgtagcactattttgggtggatgagttttattttcttttaaagctgccttaattccatttttattttgcattttagaattgcccttcatttactaaatcagccagttaatgtgattcagttgtgacctgtgggattttaaaattttcctgccctcataatttaagcaaaatccacgatagtatcagcccaagagtgtgttgctatttgtaagccccatggatcaatacataaactatgcataaaaataaaatttcatattttcgctcgtaaaaatttaggcgctgaataagaattgtgctatttctctattaatatattgttagaaataacttttctaatgaaacaaaaatgtttctcaaaatctagaaaagtgcatataaatttttgttcatttagaactgagtattctggagaaaaccaatggtcagcacttttggtttgagttatctgagattgtattttcaaaatgaattttaagtagatatttggtgtttttatcttgtcaaagacagtttcaaaatttgattcagtttatgttttattccgttctaaaatattggagatgaggaaaatgtacttgagttttgaaatattttggtaagcctctcttactcctgttatgcactttttaaaataaatactgaattccagaaagaattttctagatataaacttaatgcatactagaaatcacttggcttctaaatttggtacattatattgcataaagagttaagaaattaacctcaattataagtaaacattttgagttaccagaaagccaactatagttaaatattttatatctgagttttctataagtttggggtttgttaattttataaattaaaccacaacttttggtggtggttgtagtttcacaatggtccttttccttccaaatgaatgtagaaaattcgttattatcctgatatttgcaccactcatccccatgccacttttcccacatattaatttatttcactgcctgatctttggatatgaaattatgagttccacaaagtcaatttttatagtgccaatcaaacagcatggtgatattctttttctttttttttccccccacaaggctgttgttcagtgtgagatgacatcatttcttatttctgccatgctgtggcttttttgtgttctgcttttaaactacacctgtagtacagttaatatgttttttattggtattgatttctttaattcattaattttctctatttgggacccaagtcataagaaccaattagaggacataataaaaacacttaatgcttgtagtctgtagagatcttcaccatttcacagcacacacattattttcataataaattgccactggtgggacatgggactgacttatttgaatagagtttgaaataccacctttgtatgatgcaaacaatatttgattattttatctaagaaatctatgcatgtgtatcaagttaaaatagtgggtttaaatacaatttacaaagcattagaatgttacctaatctcttctgggttaaatgtgataggaatgtattggaatgtgaagaaattatagaaaattaaaagactcagcctctttaggaagtttgctaaaatggagaggttatgtttaatttatttatatcttcgttaatccaagcatctaatgaacaaaaaactgctacagtgacgtcataattctataagggcaatagttgccaaatttcctctggtattattagcattctgcctttgcatagattagccttcaaatttattatttttagtattatttgatacgattgaagtggctaagattgattgagcttttcttgatcacattttctgcttcttagctaaagtaattttatttaaattgacatggcttgagttgtcatcattttctgctcttctagaatgatgtgtagagaaaacttgaagatactatcccttctttggcattcttctcttaatgctatgctattatttatcataatatgcatatatttagttgtatctggtatcattctaacactcataactaccattttagttaagtccaactttatatttgttacaatgcagtgttttgggaaaggtctattagtaattatttaagtattacatatttttatggaagtctttagaaggtgaagatcttactgagaaactattttctaaataaatttaattttcttttgtatttgtatcagatcatgcctactgtatgttagattttagactattttaaaagaaaccgtagattatataaaaatttttttgctgtttttaaatggcatttgtcttatgtttaatttcacaggatgattttgatagacaaattttagaaaaccttttttcaaaggtaatggttctatcagtttcattccaacagtagctaatttctgtgtttcagtcctacagaaattgtgtgagtagttgaaataatgtacatgtactagtttttttaagtattctaaatagttctaacatttaatgcatatcagaaacatgcttaagaaataacaatatccaggcccaccccacctattgaatcagacagttcccagggcatatatatgctggggaagccccataggtgattttaatgtataccaaacatgtagagtctcactctgttgcccaggctggagtgcaatgacgtgatctcagctaactgcaacctctgcctcctggattcaagcaattctccggcctcagcctcctgagtagctggtactacaggtgcgcgccaccacacctgactaatttttgttagagatggggtttcattctgttggccaggctggtctcgaactcctgacctcaggtgatctgcccacctcagcctcccaaagtgctgggattataggcatgagccactgcgcccaaccatgaactactatcttaaacatttcctgatgttctacctttgggaagcagtttaaaatgatgctcttgaatataattttcaatattttacctggaaattttgagtacctagaactttttttttcttattattattatactttaagttctagggtacatgtgcacagcatgcaggtttgttacatatgtatacatgtgccatgttgctgtgctgcacccattaactcgtcatttacattaggtattcctcctaatgctatccttcccctctccccccaactacctagaacttgactagaaataccatcaagtaaaattctttaaattctacatttttactcgttatttatgggcaatattgatatgtacttattacagcattaattttttgagataataattatagtctactcttctgtcctctgcaactcctgcctccattcattcaaaagaggtttgctgtacagagactccttgacttatgggtttatcataagtcaaagagtatactgaatatgtattagtttcacacattgtaaagtcaagaaatcataagtcagggaccatctgtatttgtttaagaaattagataattaccatgtaaacacagtatttaatttcatgaagaatttactaaaataaacaccatggatgtgaacatccacatatttggataacagtatctggccagtgtttcaaatgctgggaaaaaaattcaaatcagaatgcataaagctgcaaagatgataaactacccttaagtttacagtcaaatggagatgccaagcataaatataacttgcaataagacaagccaagatgttgagtgttatagtaggggaaggcaagaaaggaactgctgagcagtcaacaggagtagaatggacagagaaacagccattgcttacctggataggcaaacgaggagatggctgatggaagaatttgcacatagctgatgaagagggaactaggcagaatggagagaaagcattaagtggagaggagatagaggtcagaggcatctccagtactacacctataccatcttgaaatagtcctctacccatatcctgtgctgaaggagtgagattagatagccaggtttgtaacctatgtcctcacgtgccaaccacagttgcgtgctagagggtggggattagacagccacataggtaacacatgattccatactggtgaccacagcaacaagacacttcaccagggaaaaacaattcataggctagactgagctggtaagattctttctcacaaatttgagctatgaaattctgagacaatcagataatgatatacgtataaatgaaaagatcattttagaactggccttgaagtcagtgaagcaagctaaagtctaaaggaaatgatgagtaagcagagaaagctgatctatagagcaaagttagggaatgaaacaggtttgcagagccaagagactgccctagagagatcagaaaagtggccttagtttctggctctgcagtcctactgaggtgatgcagccatgattcattttctgcccctggatgccattgattgtggctgttgtatccttatgttaaatcccccttttcttaaacaggctgagtcactttcttttccttgtaatcaggcagccccaaattggacacctaagctttgatccttggtgattgagaggatagtgataccattgacatcaagataagtcaaggagcatgtttagagaagggaagcaattttgatgtaccgaatttgactggtggtgagatatgtaggaaatttctggtagtggttggaaatggggcctgaaccaggagatgttaaaactagagatacagatcttgcagctaataatttatagaaatgattaaggcagccctgggagatggtataggagaaaaaaagatgaggacagaatttgggggaaaattcatttaaaggataagcaaagacggaaaagaagatggaaagtgatagcagaaaggaagaaaaccaaggtggcacacatttttcagaggcaaaagtggctttgtagcagtcacatggtacagagaagtaggatgtaaatctgagacaacattgggctggataattggagcatgatgatcctttagaaggcaggtacagtataatagtgggagcagaaaccagatggatatggttgtagtagatattaagaagacatgatgaatgataatactatagaaaagtttgaaaaggagaacgtttaagacaaatgatcattattttcccaaatatctgaaaagcacatactgctttattttttgctttcaaatttgaaacattgtaaaatgatgagtataatatgatctgcaacagtgtaaggtgaagcagtctttgaactgggtcttaaaggatgattgctaagagaaaaatgaaacaatacatacaatatgattgcagatttgctctttataatttagatgtgcagagaaaatgagagttttcctatggaacttatatgtccttcctcttgagcccatacccagtggtaagtctggaaaaaattaacttttagttttagccagtttaaaacctagtctgatataaaggggatagaatttatatcttaagggattttaaggtaatgcttaatcttttggagaaatgctgttttatttctgccttttgtctttctaaaatggtgtccagacatatcatacaagacaggggcatcagggtagacagagtctttgtggagcccttccattctctgggttaattatactgacctctgttgtggcaggcagcagcttataaaataagtaacaagtctttcctagtctggtcagagtccagttgtccttggctgaactgacttcatctcagttcttttggatgcggaaaactctctgaggccctatcacctgcaactctgcctcaagcagcagtgtaggtcaggttacaggtttaccacctgcaccccactgtaagctcaaggtaagcctacttgcttctccttcagccatcttctgaatctccctttgggggaatatgggaacttgtgggtctcttctatagcacacaggaagagacagtagcctgggaaatcaaactctttccagaatctggtagacatcctactacccagcatgtgaggaatactacaaagcaatgaaaagtgaacagactactgctacatgaaacaacataaatgaatcatactaatataatgttgaacaaaagaagccagacacaaagagagtgtatactgtatgcttccatttatataaaggtcaagaacaggcaaaactactctgtggggttagaagtcaggatagtggttatgagaggagagtgggagagctggcagcactggcttgttgggaaaggggtatgtatatgtttatatatatttgcctgtatttatgaaattgttagtaacacctgtctgtaacacgtaaataggataggtagaatactttttcaacttctgaactttgaaaccctttgaaagtcactggtaattttctaccacaaacctttttattaatactacttaataactttcagttagatacctacaatgacctttacttgtacgctatttcactacttggttatattttcattataaaaagaaatttagtctagttccttggtctctttctccagggttagaattttagtctctatattgtaaaatttcttttaaaaaattaccctactcagtttttcacaatagacagttatacaaagtttaatacagtcattatcttttacacatttgaaaaaagtaacttgttttaatttataaaagaaaataggctatagaatattaatctctgtgaaacaataagacaagtgtatgaaaattattttacagctactttttcatggctgttgacctactggaacaagagcaaaacctgcattagatgagtggtcataagattctccataagttgatgtccaataataatgctttttaaggccattggagacttctgcaagatatacacgtccatctaccacaaatggctccacatctgtattgtctggttttagacaacccatttgaattaagtctgaatatgcctaggatttttaggaaaaaaactatatcattaagaaaaaatgtattcaatttacagtgcttacggaaatttaaatattcaaattagctgtgctaatttgtagtttaaaataaaatattctgaataacattgctgaattttaatattttccaggtattgtaaatagatttttattcatttaattacacagaatgaaattataatattgcaaaacttatttctaacttttaatgtattagacatgttttgtcattttgtgactcctagagttgattttctatactaccaattttgtggaccaaagctcctatggtcaaaattttcaagtcccacagatgttcataaattggaataggtaggggggctcggtaggaggcctattgtatacattctcaaaaatctgctgatagctagttacccattcctcagaaaaattaagggaatcccagatttggacatacaattatatagagttcatgacccccctgaatctaatctacagatttaggctaaaacagacaattccatagtattggatgcggacctattaattatttcttcattgtagaatttttatactttttttttttttttgagacagagtcttgctctgtcgccaagctggagtgcagtggcacgatctcggctcactgcaacccctgcctcctgggttcaagagattctcctgcctcagcctcccgaatagctgggactacaggcccagcgcaccaccacacccagctaatttttgtacttttagtagagatggggtttcaccatgttggccaggatggtctcaatctcttgacctcgtgatccccccgccttagcctcccaaagtgctgggattacaggcatgagccacgatccttagtatctatgtaacagagtcatacaaatacgttgaactggtttgtcagtaaggttggcaatatggagaaagatggaaatttagacattaaaagatttaaaagtcaagttggtttttgctttagcttgtcattcatcattagttccagttccagactcaacttattcagctactgatgtgtagaacctaaagaattatggatgtttttctaaaagtaagggttggtttttttgggagggtggtttagacaacactctatgttttattactctttttagtggtggaatttttgttagtccttttgcaaattttgagaattttaacatctactttttccccctcgttctttccaaatgaaaactgttaccattatttctgttttgaaagtagtatcaaaggctgtctgtatttatgtgagcaacatgccaaatattttgatagcttgtactctatctctcccattccatattttggtataattattagggagcagatcagaaattttgctacatctgatcaataattatgatttttcttaaccttagaggaattagaactgtgtcattcagtgatgtgtaatactaatacatagttttaatatctttggttatttgaaccaccaaactctctagtagttaattttaagacttatgttaattatcaaaactgcagtgtctcactgtgtaaccatttctgaggcacctgtaaataatatctgatgttacagagatgatcccagaaaaagccttcagtgaaggaaaaaacttaaaacttactatacacgtagcctcatcaaatttgtttccccaaatgtagatatgagagaaagtgagatttgttttcattgattgtgaaagtgcaacaagtccttctccctctatgttgttgctgactactgacaacctgaaaccaataattccacaaggaaagaatacaaaaattagcaacatttattacaaacactttcttgtgtagtcttagcattattcttcagtatgttgtaatgtagtggtaaaaatactgaccatttaattcctaaaatccaagaaacttagttttctaattagatccttaaggtacttagtagagctaactacattttgaaagtcttctgttttatattattcagtaaatgtttgggtggatagcagatatatttttctggataaatgcatccaagtattttattctttagttcattcttacttttaaaagtcttgatcatattgaatgcttctgagttttctattagaattcaggataagtaatataagcaatgcaaattttctcattaatttgaaggaatcgttaatagaatcagtctaattgtaaaagacattacatttgaaaaatagaaatgtaaatgtttactgtaacttaatactatgtcagtttagaagctgagttttcatatttcattataatcttaagagttaaggggattgaggttagtatttaaaaatttgcttttctgttattttgattaaatataaaaccatactaacgctttaagactcctgttgtgtgaagtaagagtttcactgagatagtttgcgcctgcattttctattctgttaaaggaaagatctattacttccagggtagtgttgcttttcagtacatcagccaaatacaccattccatcatgagttattttgttgctggcaaaggaaaaatagttatatttgaaaatatgaaatagtgtttttattcatagtgataagatgcttgaaaacttaaacagtactttctgttttagtaaaggtttattttaaccacttgatttccaagaaagttaatgaaaattcaccataaaatattgctttcattcttgtttacacaactaaattgctcatttatgttactaaaagatagcagtattaaatattaaagcttaggacaaaggattgacaattggttgcagtttctaatcattggaaataatgtctaacaacgtatcccaagtaccatgaatatttatatagattattcccattatttaactttgaattattaatgtgtaaattatcacttaccagctgacatcaaggtagcgcaggctactgttcagatacagtgcatcacataactgttgtataccactgttttttatatcatgcttacacatgtgtagtgcaacaagacagtgattttctttcaacatgcggcctacatggactgtagactcttcctaaaagtggataaaatcttatttctaaaatataattttgaagtagtacatgtttatttcagacatatgctgttatttaaattagctttttaaaaagattatattggttaaaactgttagtccacaatttgcatttgtttggtctatctttaaaaaattatctttgccacaaatgatattttttaccttctcagaaggtaaaatatagtcactatattttacaagtgcctgctacctaagtgatgtaaaagaggctggttaatttggttttttaaaaaaacaataatcagtcatttcgaaaggaaaaaaaaattggtcccatcatgtattgagcatgtaatccatctttcaagtctctaaacctttcttataccttccatatgttcctgaactttgctcttgatctctactcttgatggttttcagacaaaatacaaagacatttcccaatctttattttatattaagaatacactcattaaccctgtgatatatctgatccttccctttatattcatctcaaattcctaagaggttttattcttattttctgatcatcagaagacttttttttaagttccacaatctagctacttctaggtaaaagatacatggcatcaatgaagatttgaataccaggcattttaagtttttagtaaaatcaaagcatattttcaaatgaatggcccaaagtattttgtgacaagaagtactcttgcatgattgctgtataacataataagttttttagtcactggaaatgctgatgatgaacacagataactatatgtgttcttgttatatataaaggtactttgaaaaaaactttaaatgaaaccacatagcaatagcagaaagtacatgagctttataaaaatcaagtctgtcagatactagctctaccttttactggctatatgactttgggcaaatattttcatctagctgagtctcagtttccattttagtaaagtagctgaaattatgcttccctcacagaaataagttaactaataaaaggtacctagcacaaaataagtgttccataagcagcctacaaagcatttattattgttcaatattctgtaattctgtatttgctgaaattgctttgacactgaaaagatacacccaaaggaatgctatgtagactaggatctttaaaaatgcacgccaaccatgctaaagggatgctatgtagtctaggaacgtaaaaaaatgcaaaccaaccacttagggggttccactattgctcttcctagtgccaggcacagaggacaaactcagtacgtttttgtgtttgggccttgattgcagttttaggctacaacgcttgaaagcaggagtatcctaattaagggaggaactattgtcagaaatagtaaagggttttagccccattcactgagtttgtgacttgatttgtctagagtggcacctggcatcagtatttttcaagctccccggataatgccaatgagcattaaaggtgaagtccaacatcttaacagctttttgttatcccattcctccacggtaataaaacagtaaaacccgtacatggaatagatttgcaggtttgtatttgggaacagcaatttaagagcagaatagtacccttggggatagagaaggtagtggctgtcctggagaagaacaaaacagactagcacctagctggctgccagaagcaccaagctgagagcaacaagggggcctgggcttttaataataagcatcctcaggtggatttaggaatgacaccactcaacatattttaaaaagggatcatgcttataatgtgatctcctatatataaacatatttccacagagataaaatccagaaatgtatttagccctcgaatctcctgtcatgtcctcaatctgagaacctccctaccacactcacctcccctgctttgattctgattaccctccttatgtccccatggcaccccgggcatatcactctccagacttgtcaagctccctccacctagatggaaaactcactgaagacaagtgctatgtaatttatttgactttaatacctctagcacctcgctagcattgtgtcttgtttaaggttgcattcaaatattcatggtgtgaatgaatcatgagtgaagcaattcactgcatgcctactttgagctgtattttgctagtcttttaagtatttttaaaataggaatctatttgaagattctgagtgtcttgttgaacagattggatttacgtacatgaaacaacgtgatgtaaaaccacaaaaattctggtaccaaaaagtgcagcgataactcaaagggagagatctatgtaggcaaagaatgtaaaatacacttctgaatatgagaatactactttaaaaatatcattaattctcagtgattcatactaagggggaacaatgaagtagataattttaaattatctaaagtgctttaatcatttaaaaagttcagagtttggctgggcatggtagctgatgcctgtcatcccagcactttgggaggccaaggcaggcagatagcttgagctcaggagttcaagaccagcctgggcaacatgacaaaaccctgtctttaccaaaaatacaaaaaaatttaggtgggcatggtggtgcatacctgtggtcccagccactcaggaagctgaggtgggaggatcacttgaggccaggaggtggaggctgccgtgagccgatatcatgccaccgcactccagcctgggtgacagagtgagacctcatctcaaaaaagaaaaataaagttgagaattcaaacactgacattgattgattgattgattgattgattgattgagatgaagatgaagtctcgctctgtcgcccacgctggagtgcagtggtgcaatctcggctcactgcaacctctgcttcctgggttcaagcgattctcctgcctcagcctcccaagtagctgggattacaggcacctgccaccatgcctggctaatttttgtacttttagtagagactggattttgccatgttggccaggctggtctcaaactcctgacctcaggtgatctgcctgcctcagcctcccaaagtgctgggattacagacgtgagccaccgtgcccggccaaacattaaattttaaacattgaactttataaagtgctttgaccatttacttttcctaatagttagatatatgtttttgtttataccaataataacatgagttcttattctctagctgtttacaagtgataggagaagaaagccacccagaaggagaaagaagtcatgaaagtaggaaccacatttttactcatctttctgtctccagcaagcagcttactgcttttcatacacattttgcttttattactcatgatttcaaaggtgtaatggttcagccacatcaatgtaacaaacagttcacactgggctcttatagtctggcctttaaaaccttcactatttatgctttcatcttaactactttgaccctcacaggtttactcactaagaacttgagtttcaagagaaaagatgacatgtttgctgcttaaacaagcaatatctaaaagcatatttagttataaacgtcttaccaagaattgatataattttcatttaaacatttttataaatagtagtttacaagatatagtaagtacatctctaaaaatacagtgtattcatgtaccttgacataaacttgtagtagtaccttagttttattcatgttgttatattaactaccatcactttgaatacatacctgttcactgtacagtataggtcggtttaggtttattgccttaattgcttggttttgagttagtactgtagcaaatgctatcacactttgcattccctaaaaacaggtaaattcattaaggaaacagacaaagtatataataatctcgctacataaatatttcaagatcagctatctgcattctgataaaattgtttttaaaatttaagcattccttggactttgaattgtaagttgatcaaattcaaaaatgaattgttactgtattcttctctcctggccctaaaatctatctaaaacatggcatggggagtttcttaatgtttcagtgtccatttcctgggtgtttccctctaggttttttttcctcacccctcaagcttctatgtggatcccagctagagctcatactacttatccaacacacatcattgtgcaagcactcttttatattcatactagtacttttaagtgtgtgtgcggtgggaaaaggttaccaatcacatttttcacagatcccataggcctctcttgctctatctgactggaagggcctagtctccccatatccgtgatggacaccaccatgtacacccagctggtatgccggaaaccatgggcttcctctcactctgccattcctcttaccttcccatccagttgatcactaagacttacagattctgctgcctccaaaagatgtctcaaattagtctgttcctgtccatctctgtggccaccaccccagcccaagtcctcctcacctctcacctggactactaagtggtcagatggcttcttcttgccaccctttacttctgcacagagaaaccagtgatctaaaaccaccaatcagatcattacccctcagagcttttccagatttccatgatttgctttttccatgattttcatttataatacaacccccacttcttccccttacctgtgacccacaacccacacaactttgccatatctggcctccataagcttctctacttttacttcaaggcactcttaactttgtctgctcagccattctgacttctcagttcttaaaacctgtgacacttgctattttattattcatgtacctccctcgtgatttttgccatatctcagtatgcaaaatatttaacactatttttgtttttatttatttattttttgagatagggtctcactctgtcgcccaggctggagtgcagtggcacactcggctcactgcagccttgacctgctgggttcaagcaatcctcccacctcagcctccctagtagctggcatgcaacaccatgcgtggctaaattttgtattttttgtagagacggtattttcccatgttgctgaggctggtctcaaactcctgggctcaggcaatctgcctgccttggcctcccaaagtactgggattacaggcgtgagccaccacgcccaaacttactttacaccatttacttaatactttcccattaaatcaactcactttttcaattatatttattttaaaataaaactttgtatcactgctgtaaatggaaaaccataatcccttgaaacaaacagaaagcatctgtaaaaataaatatatgagtatgaaaattacctcactctgcaccaagaatgctacccatgccacacttagggaagcactatcttaatgtctgtgcatgctggtgctctgcctggaaggttctgacatggacactctccatgagttttttctcatccttcataactcgtaaatattaccttagtaatataagtcttaggcaaccctcctgtagcagaattacttctccccattatcagagtactcagtcatttttgtagcactttcctctacttcttcattggtgtttccccaactaaaatataagtttcataagggcagaggcagaggccatgtgattcactgttgtatcattagtgtccagcacaatgactggtatgtggagatgataagtaccgaattaatgttttcccagaaccacactggctgcatctaccaccttaaaaagttaatcttggccaggcgctgtggctcactcctgtaatcccagcactttgggaggccgaggcaggtggatcacctgaggtcgggagtttgagaccagcctagccaacatcatgaaaccccgtctctactaaaaatacaaaaaaaaattagctgggcgtggtggcaggcacctgtaatcccagctactcaggaggctgaggcaggagaattgtttgaacccgggaggtggaggttgcagtgagccgagatcacgccattgcactccagcctgggtgacaagagtgagactctgtctccaaaaaaaaaaaaagttaatccttcagaatctattataccagagagccccctggcccatcttattttcatgtcacattgattaacctgaggctatacaacaggttcccaagagtaggcctaaagatttgaaagcatgtcagagaaagtgaagcctggaatttgaagacatgcaaaaaaacacatttttcattatcaggccaggtgaaggttcaaagcgacttttatcttttttaataatttttagagacagggtcttaccatgttgcccatgctggagtacagtggatgttcacaggcacggttgtagtgaactgtaacctcaaactcctgggctcaagagattctcccacctcagcctcctgaatagctgggactacaggtgcatgtcatgtcgcccagcttcagagcagcttttagcatcatcattttaagtttttgtgctacaatataagtaactactaaaaagtattttatttttgttttgagtcagagtctcactctgtcgcccaggggctggagtgcaactcactgcagcctccacctcctggttcaagcaattctcctgcctcagcctcctgagtaactgggattacaggcttccgccaccaggccccgactaatttttgtatttttagtagagacggggtttcaccatgttggccaggctggtcttggactcctcacctcgggtgatccacctgcctcagcctcccaaagtgctgggattataggcgtgagccactgcagcctaaaatgtattttcaaaagtaaaaaattatatgaataaagtaatatttgtttaattaaagtgaacatgatctttttctaaaaattccatacagtttaagatgagttatatagatggaagtttaggaatatttttattaagtatttttctatgttatttactatagtctgattttattaataatctgcactattatgtctaggggaaaaacaccttttctctgatattagacataagaggcaaaattaatcattcataagactctgatttagctgttctctaatgacccactatctggatgattttctcataaccagtttactcaccagatcacagtcacccagatctaatttctctaatgatgaattaatttgcagcattgcagcaaaaaacattccacctttattttcaattttgtttccagtcattcttaggtatttcagagtccgattcttctgaaaaggaaaaaaaacttatttaataattgttaatccacagaattctatatattacatgaattaggagactgtattactatttgcagactccaattttcatggagctagaacacgatatatattttttttgagacagagtctcgctctgtcgcccaggctggagtgcagtggtgtgatctcgactcaatgcaaactccacctcctgggttcacagcattctcctgcctcagcctcccaagtagctgggactataggcacccaccaccacgcctggctaatttttttctgtatttttggtagacatggggtttcaccatgttagccaggatggtctcgatctgacctcgtgatctgcccagctcggcctcccaaagtgctgggattacaggcatgagccaccgcgcccagccagaagaggatatataccttaaaggtaacattcaatctaccataatagataaaaatctagtttaacagttgagtagaaagaatgcccaagaaacagatgcccaagcaataaccagtaaataaaacatatattaataaactttcactggaaaaatctgtaaatttatcttaagaaaattatagcacttcacttttttaaattgaggtgaaattcacataacataaaactgaccattttaaagtatacaattcagtagcatttagtacattcacaatattgcacagtcatcacctgtagctagttccaaaacattttcatcatccccgaagccggtcctataccattaaccagtcactccccattcctcctatatcacttttaaagtaatataatttgataaatatttcacaaaatcacagacatttcatcattctaatgagtaactattaggacatataatagtgtaaataattatcacgattcaaacccctctgagatcaggaagaagaaaaggatgtcctctcaccacttctatttaacattgtactggaggttctagccagagaaattagccaagaaaaacaaaaagaaaaaccatacaaattggaaatgaagtgaaactctgtatgtgacaccatcttgcatagggaaaatcctaaggattccaccaaaaaaacctgttagaactaacacaagagttcagcaacatagcaggacacaagatcaatatacaaaaacagctgtatttccatatgctaacaatgaacaacctaaaaatgaaattaagaacaacagttccacttacaatagcataaaaaaaagttaggaataaatttaacaaaagaaatgtaagatttgcacattgaaaactacagagcattgctgaaagaaatgaaaggccttaaataaatgaaacatcttatgttcgaggtttggaagacttaagatggcaatactccccaaggtgatctacagatttactgtaattcctattaaaatcccagctgctggccgggtgaagtggctcatgcctgtaatcccagcactttgggaggccgaggtgggcagataatctgaggtcgggagtttgagactagcctgaccagcgtggagaaaccctgtctctactaaaagtacaaaattagccaggcatggtggtgcatgcctataatcccagctacttgggaggctgaggcaggagaattgcttgaacctaggaggtggaggttgtggtgagccaaaatcgcgccattgcactccagcctgggcaacaagagcaaaactccatctcaaaaaaaaaaaaaaaaaaaactcccagctgcttttcttgcagaaattgattaactgacctaaaattcatatggaaatgcaagggacacagaagagccaacacaatcctgaaaaaagaacaaggacacatttcttgattttaaaacctactacaaagctatagtaatcaagatagtgtggtactggcataaggatagacatacagattaaaagaatagaattgagagtacagaaataaactcctgtaatgatggttagctgatttttggacaaaactgtcaagacagttcaatgggagaaagaatagtcttttaacaaatggtgttaggacacgtggatatacacatgcaaaagaataaagttggattcctacctcataccatattcaaaaattaaaatggatcaaagaaagagctaaaactgtaaaactcttaaaaaaacataaatctttgtgactgggttttcaagatgaaccttgaaaacattaagccagtcccaaaaggccacatattgtatgattctgtttatatgaaatgtccacaataggcaaatacatagagagacgaagtaggttagtgactgccaggggctggagagcagggggtagaaaagatggagagggattgctaatgagtttagggcttttctttttggggtgataagaatgtttttaaaatagtgatagtagtgatacttgcacagccctgtgaatatattaatacttaaaaaaccactgaagactttcaaagggtatattttatgtatgtgagttaaatcttagtaaaactatgacttcaaaagtgttcatgcaatgtctacacttgaataaattaaagtataataaaaatatacattcctacaatattaaaataagttcacttcaacattggacactgttggttccaagctatcagaagttagaatttccaaatacaatgttagtttgaaatacataaatgcttacatgtagcactttagcaatcaattctccaccttcgggcccaatatcattaaacatgaggtttaagtaaatgagattaagttgtttctataagagaaaagaagctattacacattattattattggaaattggtcagttttacatacatgtatatacatatacacatacagtatatactttatttgaataagtgttttcctccaaagaaaatctttataaccaagaaaaactgtatcctagcaaaaacaactacattaaggaaaaaaatcattctcatgtaatcaaaatataattacaatataaatgaaagaaaaaactatatttacctttgatcaatctgaaagatgtgtggtgtatatatttaatcatggtgtacaagtttgcaaaagataacttaggagctctagctactggctccattgagaccaaatccacaatgggtttccagtatatttcgagtgttctagcacagagtcaggacccttgacatcaggtaaaactagtgttttatgtgtgtgtcattagactaattggtttcattgtaaatggaactaaggacattttgtagtaaaataatacctgaagcagtttcgcagcatagtatgcaccaacatcacatagaaggttatatccaacatccaaacctgaagcacagatgaatagaagtggatattcattataaagaatacttaaaatcagatcaatgaaaagcaggaggtattgattcttatggaaacataccattaatatacagacaattctttaaaattttggaaagaatccaaaaatcttcacctgtaactctttctactggcactaagcgattgttaccagcaatgtttaatgtgattcctgctgctagcctgttaaaatacaaaaaaaaaaaaaaaaaaaaaagattttgaaatagaaacccagtaaagaagtaaaagtatgtttccttcatgtataaatagtcatatcacagatatcatttactggaagcaagcatataataagtagacttatacagtatatttataccaggtaacttaaaactactgaacattctgcagactgcaaagtgctttaaaagattccatatatttagctctctcacacacactcacactcacacaaacagtatccccactttatagataacactgaaaacttcagtgatttgcttagactcacccagctcaggttaggcgtggtggttcacgcctgtaatcccagcactttgggaggccaaggcgggctgatcacctgaggtcagaagttcgagaccagcctggccaacatggtgaaaccctgtctctactaaaaaatacaaaaattagccgggcatggtggcgagcacctgtaatcccagctgctcgggaggccaaggcaggagaattgcttgaacccaggaggctgagtttgcagtgagccgagatcacgccactgcactctagcctgggcgacagagggaggcaccatctcagaaaaaaaaaaaaaaaaaaaagattcaccctgcccacaaacaaaaaaaaaagattcaccccacccacagaagttaaagatcactctggagcccaagcttgggtactcctggtctagtgctctttcctgaatactataccacctctaagacctactaacagtgttgctcgtgtacttacttacctgaatcaaatggtatgttcattttaccaagcattttcaaatggctataaaatcactcaatatgttaggattttcacacacatgaatataagcaaacactattaatgtaatcaagtatttgtctttcttacccctttttaatttcttcatccacttcttggagtatatgcaatataaaaggattaattttctgggatttttccatacacagattagaataatgtttctggagaccagattctggagattctgaaaaatatatgcatcctctatcacatataaattattctagaagctttaaaaaaaaccataaaaactacctctttcaaatatatgagttgtatgtgtgtatagtgggggtagggaagaaaaggaaacagaattaaggttagaaaaagagaagagaaataaaaataatgaatgggagagataattaaaatgctgtttggagaactagggccattgaagcacccattgaggcttggcagacactggctcaagtgagcaccctacgttggaagtgacataaagggagaactaagctccattatgtgccaggcctggtagctgaggaaaatgacttccaaagaaattgtatattttgtccaaaaccatgcagctaataaaggcagagtgcagaatcaaactgattccaaaacctctttccactgtgccctaatgggttacagggactcaaggtttcttttttttttttttttttttcaactcagtatctcagcatccacgagaggaaaaggtttcttaaaatagcttcacataaaaacaattttatctaataacctaactcaaaagggatctgataaagcacctactcccacaagcttcttggataccctctacaccatcccaagtttgaatgtaactgtcatttcttcataccaaatcgaggcctggctcacagaagctcttctcctacccagccttccatttcctctttctaaaggtgacttttccctaagttcttaagaagacagacacaaagcaggagttgagatctcctttctgttatacatgcagatttccttaatgaccttgctgttctcagtaatacctcaaaagcatcttctgcaaggcctacatcttctggggtggaagttatgctgttacttttcttagaagtacaggccactgtctttgttttctatacatctaccttttgtggatgtcttttaaaaatttgtgcacagagatctcattgctcaaccagcctagctttttaggagctggcttctcttctaagtctctacatctcagaaatgttgtttactgagtgtcctttgcactctgaagaataatgagtttgctaaacggatctgcagaacgagatttaacatgaggaacattacatttcagatgaaagcaaacaaaattttcttatagtttttaataacctttttaaaaataaatttaatatacttattccagacaatttggaaatttcttttttttttttttttgagataggttcttgatctgccacccaagctggagagcaggagcgcaatctcggctcactgcaacctctgcctcccgggttcaagcgattctcctgcctcagcctcccgagtagctgggactacaggcacacaccaccacacccagctataaagacggggtttcaccatgttggccaggctggtctcaaactcctgacctcaagtgatcagcctgcctcagcctcccaaagtgctgggattacaggtgagccactgagcccgaccggaaatttctaacattaaaaaaaaatacatgttaatctgcaatcccactgccaaagaacaaccacaattgaggtctaggcatacatacttcctatagtttttcttttatatgcatattaagtattttttaaacaaaattggaatctttggatataactttatatgctgttttttaaattaacattatattgtaagcagttttcccatgtcactagatattctctgaaaaatttaaatagcataatttctgtcatgtggatagatgtacgtattaaaaaaagcttcacctattttagaaaattttcatgtatttaaatgatattgtagcacaatatttcccaaactgtattttgtggaatatgcatgttctacaggatgatcaaaggtgttccaaatagaataggtcttattatcaagtaagtctgagaagtactaaaataaacaaaactatacacagacacaacacttctcagggcatttaaaacgtgcacactctgcaaactgttaagcttgagaatagggaggataagaatgctgcatttccggccgggtgcggtggcttacgcctgtaatcccagcactttgggaggccgaggcgagcggatcacttgaggccaggagttcgagaccagcctggccaatatggtgaaaccctatctctaccaaaaatacaaaaattagctggtgtggtggcgcatgcctgtagtcccagctacttcggaggctgaggcgacagaatcgcttgaatgcgggaggtggaggttacaaggttgcagtgggcagagatcgcgccactgcactccagcctgggcgacagaggagactccatctcaaaaacaaaacaaaacaaaaacctcacttggaatgcaatctagaaaatgctgctttagcgtcctccccaggaaacaaagcaagtagatcccaaatagaagttggagctgggctcccactgggcttctttcttccctactgtcttccttggtattaagagaaaaattgccctgagaatctccgagggcacagaaatgtgtcagactacaattcattttcgcgaaggcatgaaggaatcttagactacgagctaaatacagctaaacaaagttatggaaatattcttatttaacaagctagccagagatttacagtatttaaaagtttctgctacccttcctttgatttaaaattcacctacgtattttgtatgccaggattttgtggcaccaatgaatttatttcctatattgtattcatattagaaggaaaatagccttcaaattgtaaagcaaaaactaggaaataacccagctacgcaggaaaatgtcaagaacctaacccaaatttcattttttcatccacgcctctggcagccacgttttaacaatttccagagagaggacttacttaggaggtagatccctccaaaacatgcttttctatacttagccaagcactgggaaatctaagcgataagcatgagtcagaacgtgggtgccctatccagaatccgcagtgtgtacatttgaacaagttgttatgccagcttaaatttcctctcatgctaaaggcagagcctaacactgcccatctcctggatgcagtattattaagccagcctccgaacacagttccgtatccacaaacagactttaaaaccagcatataaaacggaaatggcgggtagggggtggccgttcagggtaggtgcttaacttgctaatcatgggcgcagaaatatttaaaacggagatagtacagaggtgcaaagtcagaaacagtatcaagaccctcatgcccccctgtgacctgctctctgggactttcacaaaaagggggctgagaagagcccccccgccaccccctcccggagaccctgagagcacggcgacagacaccatctgcacaacctatcgcgcaaagggcggacccacgggaactcctctccgtggactcctctcctgcccccggtcgcaaagggcgaccggggactcttctcctgccctcgtttctgggcgccccaaacctctggccacagctggggttcccaggggcccccctcccgcctcgacgccttgggctggcgggctgctgggaggactcctgccgtgcgaccccggcgcccctcgcgcgttttgtctgggccaggccgcgcagacgtgctccctacttcttaccgcgctggaccgccagggccgcgcccggagtactggcctgagtggaggcccaagccggggacctggccggcgcacgggcggcctcccgggagctccccatgctcctctcacccactggccgcggcggctgcgctgccatggcgaccgcgcgcgcacttacagtccgcctgcagctgtgaggcggctacacgagcctcggcgccagcctgcttcgagtcccgctggctgtgcctgcccgggccctgaggcctcactgctaaggcagtgaccgcctactctgtggaggtcctttgtcaccctgccctggttaaaggcagcctgagggagggcgtcctggctcctttgcagggaggagttcccgaggtttgaggggctccgctgctgagctagggctggggctacaaagaagattatgacaaagcccgctcctacaaagtgtgcaccggcctgccgggccagcgaagaagcagagtagcatcagcacatgataaaggcgttgggctttgggagcataaagggttttgtgctcccaaagggcggggccaccagggagggcttcctgaaggaggtgacatctggatggtccgaaggaggctgccagaggacagaatgcttggtgcgttctgggcatgcgcaggtacttgaatgtactcagatcagtacagacagcggggaggcgggcagggccagatccacatgtgttactaaaaggccaggggttccgtctagatccagctgctcctggcacagaatgccaatcactgaaacaatgagaattgccagggaggaaggctttaatctggtgctgcagccgaggagatcagtctcaaatctgtctccccaaccaactagaatcaagggtttacatagcaagaaagaaatgtgactacttgcaggaaatcaggaattagggaggggtaaggaagaggagttggtcaacaggaatcaggtggtcgtttagggaatcatggtgggtgagggatctggtgtctcattgtccagatgtgacgatctggtaagtttcatttccttgatactgaaatggtaatagtttccttatcccccttgcagggcatgcgatggtgaggcaggaaaatagggtctggaggtagggaacataaggccgattcgcacttcggctataacaggaaatatcctctccatagggtgtacaccataaacgactttgtaaccttacttcatcctcttcatttacacagggcgtactctaagtaaccaatggaatcctctaagggatatttaaactcccaaaaaatttgtaacggggtctttgagcccctgtgctcggcccactcccacactgtggagtatactttcattttcagtaaatcccttcattccttccttgctttgtgcgttttgtccaattctttgttcaagacgccaagaacctggacaccttctaccggtaacaatgggggtgtggcttgcttctttggtgctccgctgctcaaacctctagggggagcatgcagacgggcaggttgtggggcacgtgggctccgaactcaccgcagcgtctaggggtgaatgcttacagctgctgaagcaaagccccagtaggcgtgtgttacagggtgctctttcagttttgctgtgtataggcggcttgcgtcaatcagctcagttagaccctctgtcttaccgcaaggacagagggctttctgtttcctggggttctggccttggtgtaccggaaaaatcggatcacacagtgggcttggagaatgagtgcaaggttttattgattggtggaagtggctctcaacagatggatggggagccagaaagggaatggagtggaaaggtggttttcccctggagtccggccgctcagcagccagactctccactgactgccctggccaaattcccctcggtctacacatcgtgctgcttgtcggtgacctggcagcgtccgctggtgcctgtcggtgtgctcttctgctcctctgttcctctcaatgtccagccacctgtgtgctcctccgccggtgtgttcctctcaacatccagccgcttgtgtctgtgcctactagggtcttggggtgtttgtttgtttgtttgttttttgagacagagtctcgctctgtggtccaggctgaagtgcagtggcctgatcttggctcactgcaacctctgcctccgagcttcaagcaattctcccacctcagcctccagaatagccgggattacaggcgccccccactacgcccagctaattttgtatttttagtagagacagggtttcaccatgttggccaggctggtctcaaactcctgacctcaagtgatctacctgcctctgccgcccaaagtgctgggattacaggcgtgaggcactatgcctggccctttaatccattttgatttgatttttgtatgtggcaagagataggggtgtagtttcattcttctgcatatggatatccagttttcccagaaccgttattgaagaaactatcttttccccaatatatgttactgatacctttgtcaaaaacgagttcactgtagatgatggatttatatctgggttctctattctgttccattggtctatgtatctatttttatgccagtaccatgctagtttggctactttagctctgcaatataattttaatttaggtaatgtgattcctccagttttgttctttttgctcaggttagctttggctatgctggatcttttgtggtttcatacaaattttaggattattttttctatttctgtgaagaaggtctttggtattttgataggaattgtatataatctgtaaattgctttggataaaatggacattttaacaataattattattctaatccaagaacataaaatatctttcctttttttgtgtgtgtgtcctctttaatttcttacttcaatgttttatagttttcattgtagagatcttttacttctttggttgagtttgttcttaggtattttattttatttgtagctactgtaaatgggattattttcttactttttctgattgtttgctgttggtatataaaaatgctactgagttttatatgttgattttgtatcctacaactttattgaatttgtttatccattctaataattttttttggtggagtcttaaggattttccaaatataagattatatcatctgcaaacaaggataatttgggttcttcttttccagtttggatgctctttatatctttctcttctctaattgctctagctaagacttccagtgctacactgaataatagtggttaaagtgggcatccttatattgttccagatcttagagaaaaggttttcagtatttcctattcagtatgatactacctacgggcctgtcaaatatggtttttatcgtgttgaggtatcttccatctactcccagtttattgagggcttttatcatgaagtgatgttgaattttatcacatgctttttcagcatcaattaaaatgatcatatggtttttgtccttcattctgttgataggttgtatcacattgattgatttgtgtatgttgagccatccttgcattcctaagatgaatgccacttggtcatgatgaatgatttttttaatgtgttgttgaattcagtttgctagcattttcgttgaggatcttcgctgagaagatccatcagggacattgccctacagttttctgttttttggtttgcttgtttgtttgttttggtgtgtctttggttttggtgtcagggtaatactggcctcatagaacgaatttggaagtagtttttcctcctctatttttcagaacagcttgagtaggattggtattagttcttctttaaatgtttgataaaaatcagcattgaagccattgggtcccaggtttttctttgctaggagactttttattatgactttgatctttttacttgctattggtctattgaggtttcagatttcttcatggttcaatcttggtaaatggtatatatctaggaatttatccatttcttctaggtttcccaatgtattaacatatagttgatccttggaatttctactgtatcagttgtaatatctcctttttcatctctgattttatttattggatcttctctctttttctcttaatctggctaaaagtttattgattttattcatcttttcaaaaaacccaacttttcattttattaatttttttgcattgttctttattttaatttcatttatttctgctctgatttttgtgatttcttttcttctacttttttttttttttttgacagagttttgctctgttgcccaggatggagtacagtggcatgatctcagctcactgcaacctctgcctcctgggttcaagtgattcttttgcctcagcctcctgagtagctgggattacaggcacacaccacaatgcttggctaatttttatatttttagtagagacagggtttcaccatgttggccaagctggtcttgaactcccaacctcaggtgatccacttgcctcagcctcccaaagtgctgggattacaggcgtgagctatcactcccagccttctactaactttgagtttggttttttacttttctagttctttaagatgcatcattacattgtttatttgaagttttctgcttttttgatgtaggcacttattgctataaacatgcctgttagtactgctttcactgtatcccataggttttgttatgttgtgtttccattttaatttgtttcaataaattttttaattttcttaattttttcattgacccactggtcattcaggagcatgttgtttaatttccacgtgtttgtacaattcccaaatttcctcttgttattgctttctagttttattccattgtgctcagagaagatacttaatatgattttgatatttttgaaaatttttaagacttgttttgtgacctaaaatatgtctatccttgagaagatccatgtgctgaggaaaagaatgtgtattctgcagctgttggatgaaatgttctgtaaatatctaggtacatttggtctatagtgcagattaagtccaatgctgctttgttggttttctgtcttgatctctccaatgctgaaagtatccaatgctgaaatcaacagccattattgtactggagtctatttctttctttatctctagtaatatttgctttacataactaggtgatccagtgttgggtgcatgtatatttatgatcgttatatcctcttgctgaatgaacccctttatcattatataatgaccttttttgtctttttttatagcttttgtctcgaaatctattttgtctgatatatgtatagctactcctgctcttttttgttttccatttgcatagaatatcttttcccattcctttattttcagcttatgtgtgtctttataggtgaaatgtatttcttgtgggccacagatcgatcattgggtcttgttttttaaaatccatttagcacctcaagagcaattcctcagagcccagcacagcatcaagatttgcccaggaattgcagtccttgtgacctagactgcctttcaagtttatttagaacccccagagcactttatcccacagtggtggggctagccagaactcacgttccacccactggcatggacaattcccctctggctagggctggtctaaatgctccctccatgagcaccacctgaattctacccgatgttgctttccactgtgacaggcagcactgaagtccattccaaagccccacagtcactttcctctccctccccgaagcacacttattctctctctgtgccacatggctgctctgggggttggaggagggatggttctgactatccaggactgtctttcctaccttcttcagtgcctctttctttgctatgatgttaaaaccagggactgtgattgcaaacctgatctttcgttcttatgaagatgatttcttgtgtgaatagttgttcaatttggtgttcctgttggaggggatgattgctagagggttctattcagccatcttgctctgcctccaggaattttttttttaacaagatgtatttgtacagaattctctcagctatgactccctgttgaagaattttctttctggtatagggaaggcatgtttcacatggaaggttttatttcctgttttcaaggcgagaaagggaagattagaatacacttattgcatctgctatttttcaagtgtctttagcttaaagtaatcctcataccaaagtggcatattttggagtggcatattctgccactctttattaccattacatgaatatccagtctgaagtcaattaaggttacttttagtttgtttgtgattcaccagtttttagaaggagaagttctgctgagtgaagttttaagcaaaatcttgaaattcttttaactagaaatgggtttttatgctaacagagagagtcacacaccatattaacctcaggaacctagtcttacctatctagtttgtgcatagacagacttggaaacaaaagcatcaacactcactgtaaatttgagagggctgattagtttcttaaatgattttctcaggggttagagttacacaaagaaagctaattgttaaactatccaaatcttggctccttcaaatgaagatgtaacaattatttaatttaaaaatcacccgaccataatattggattgtaataataagtaaatttgatcacatttgtgtagcaatccctagagaaaaaatggccaataaagaccaaatcttcccctttctcaattactgtggcagaattactggcaaagctattgcaaatctgggttttacaatctccttttattaaatccacaaatgaacgtgaaatatgggtgtatatatatagctttcagagggccgtcaaattgatggggtatatgattaaggtgagataacatacacacacaatcagatattctaagcaggtcttattatggagaaagatgaatgctaagagaaataagttatttcatgtgtctggaagcccagacaccctcatattaattctaatccacataaatttctcccagttgactttgttgtaatgctgcacaataaaatcaagtctaaaatttcacacccgagaagaatgattttaataagtgccaggtttcctgtaaacgagtgatgttaaaaatctaggtgaggttgtgtccagttctctgctcttactcccacttcctaccatgttctgagaagagcccttttagttatataatttctttatctgggaaacagggcaaataatgatgcctcctgcataggattattgtgaagattaattaggttactttaagtaaagcctggagtacataatcagtgttcttggtgttccctatttttatttgtattatcacctcagtctacatactgtggagaattttcagaaatttgcaagtaggaaactggagattttatcttacaggactgaacagtattagataaatttaatctgcctgatgactaagtgacaaaaatgctggagacagctagttttaaacaaaatcagtgttaaatctttccttttctttaaataacattgtctcagagctggttttgagtccaggcataaagcaacaagcacctgaagcacatagtgttgtgttttgaggaatagcagtattatgtatggggctagaaatgtatccccttcatctaggcactgggcctctgtgatggatgagaggcccagatactccagcaggactgccttcattctaaaaagaagttcaaagacgctaccgccaaccttgccactatcatgtcatgttgttctctgcctttccccatagactctgtgtgtgtgtgtgtgtgtgtgtgtgtgtgtgtgtgtgtgtgtactaaagacttactcttctgaaatacaatattcacatcttgcattttataagatttataagcctagtagtgtaagtctgctgattttgttttcactaaagattatctttagctcctttgcattttcatataaattttagaatcagcttgtcaacttctaccaaaaaagaaaaaaaaaagtttgctaaaattttgactaacattgcataaaaactatagatccaattaggggaatattgacatctttttttttttttttttttgagacggagtctcgctctgtcgcccaggctggagtgcagtggcgcgatctcggcttactgcaagctccgccccccgggttcacgacatcttagcattactgagaattctaatccatggacatgatttgtccctccatttatcagagactttaatttgtttctgggttgggctttagttcattcaattaaccgcagttccaaatgtctcacttagacagagttaagctccttccagccaggcttcggtacttaagaccatgaaacttcaggacctgtctctgttctttagtccagcctgcaattttccctgtggccgtttaaccagccaaagactaatgggaaaaactagttagtggggagaactgactttgcatttggggctactccagattctaatccactatgccagcccacacatgactgttaaaagtttggcaggtttattcttctcccagaagttcctttgcctgtgcctattaaagggttgtttctctgcctgacagtcctcaaacttgcaaatgccatcaggcatgagagggtctactcacgggtctctagttatttagaaaaggttggtgcatctctagaatatagtgtttttgttgttgtttttgtttttgttttagctttctttgtatcttcgactctctggtggttttaaggaaaaatactgtattttaaaagatgaggtttttccctagtgttttctcagtgttatggtaagagcaaggatcttttgcaaccttctacatcctactggaaacattcagaataggcatttttttttaactgaaattaggctgggcacggcggctcatgcctgtaattccagcattttgggaggccaaggcgggtggacctgaggtcgggagtttgagaccagcctggccaacatggtgaaaccccgtctctactaaaattacaaaaaaatttagctgggcatggtggtgggtgcctgtaatcccagctactcgggaggctgaagcaggagaatcgaatcacttgagcccaggaggcggaggttgtagtaagccgagatcacaccattgcactccagcctgggcaacaaaagcgaaactccgtctcaaaaataaataaataaataaataaaactgaagttaatctctttttttttttcatgtgagtctacgtgttaggggaaggagtctacactttaattcttctaacatgaaatgcaaaaacctaaattttatgttctgtcataatttcaagcactaagtttaatcaactaggttttaattttatttttcttaaggatagcaagtctggtggcaggtaaattctattttttttcatccttttcacaatatttcagattttgaatatttgagcttttcttcacaataatgtcaaaagacataaaatcagtagaacattcacctaaaattcatcagagaaatgatccacagcacgtcaatgatagaacatttttcattgatgcctctaatcagagcttgactgccattcctttggagatcttcacattcacagaattagaagaagtgcatttggagaataaccagattgaagaaattccccaggagattcagcgtttaaagaacatcagggtcctctacctggataagaacaacctgaggagcctgtgcccggcgctggggctgctgagcagcctggagagcctggacctgagctacaaccccatcttctcctcctcccttgtcgttgtcagcttcctccacgccctgcgcgagctccggctctaccagaccgacctgaaggaaattcccgtcgtcatctttaaaaacctccaccatctcgagctgctcggactgaccggaaaccacctgaaatgtctgcccaaggaaatagtgaaccagaccaagctgagggagatctacctgaagcgaaaccagtttgaagttttcccccaggagctctgtgttctctacaccctggaaatcattgacctggacgagaacaaaataggtgccatcccagaagagatcggacacctgacggggctgcagaagttctatatggcttctaacaaccttcccgttctgcccgcgtccttgtgccagtgtagccaactgtcggtgctcgatttatcccacaacctcctccactccatcccgaagagcttcgccgagctcaggaagatgacggaaatcgggctgagcgggaaccgcctggagaaggtgccacgcctcatttgcaggtggacctcgctgcacctgctctacctgggaaacaccggcctgcacaggctgcggggctccttcaggtgcctggtcaacttgcgcttcctggacctaagccagaaccatctgcaccactgcccgctgcagatctgtgcactgaagaaccttgaagtcctgggactggatgacaataaaataggacaggtacggattccttttctggctgtcactatgctctcatccagggtccttcctgccctaagttggttctgtatctaaacagcaaatttgaactgactttatgggcgaaaatccaagattactaaatatccaacaaggtgatactttgtattactctctttttccctaacagcagcagtaatcataatagtagctaatgtttatttagagggtgtatgtgccagtcactgagctaagtgtttacatggatcatctcatttacctcacaacgactgtgtcctcaatggtatatgaaggaagtgaggggcagggagcttaactaacatatccaaggttacacagcctgtaagtgctgcagccgcgattccagcccacagctgccaggctccagggtctacattcttttttttttttttttctcttccccgagacggagtctagctctattgcacaggctggagtgcagtggtgtgatctcggctcactgcaacgtccacctcccgggttcaagcggttctcctgcctcagcctttcgaatagctgggattacaggcacctgccatcatgcccagctaatttttgtatttttagtagagacggggtttcacggtgttgtccaggctggtctcgaactcctgaccttgtgttccgcccgcctcggcctcccaaagtgctgggattacaagcgtgagccaccgcgcacggcccagggtctatattcttaacaaagacaatctcctgacagagtttccgttaacagcagatgtttctaatacacaacagccttagaagcctaaagttccatccataggaaactgcaaaaccagacttgtcccaacagaaactgtcccgtgtgtgcagggtggcatattcaaaaatggtcatttagcattgttgataatcatgaaattatgggagacaatctaaatgtcagtaggggagtgggcaaataaacttcaatatattcataaaacgaagttatatagtaatttaagtgaactggtactgtattgccaatatggatagatctcagtattgtgatgtttattgaaaagaaaacctaaggttccgcatcaaactgcagaaccttatgataccatttataaattttgaaatcacacaaaactatatatatacacacatatatgtatatacatacacacatatacacacaacacatattttatggatatttttatatataatgaaaatataaaatattgactggaagaaaactaaattcatgaaggtggctgcctctgggaagagagaaggaagtcaacaaaatagggaagcagctggatgcagtggctcactcctctaatcccagcagtttagggggccaaggagggaggatcactagaggccagaagttcaagaccatgctgggcaatgtaggaatgtgtctttaaaaaccaagaaagcaaatggggaagagatcataaggggactgaacttaattgcagtatttcattttgtttattaaaagatttgggcagttgggcacgcgtgggtttatgtttctttattattttataatattctatttatttcaattttaattttatttatttatctatttatttttgagatggagtctcactcactctgtcacccaggctggagtgcagtggtgctatcttggctcactgcaacctctgcctcctgggttcaagcgattctcctgcctcagcctcccaagtagttgggactacaggtgtgcgccatcacacccggctaatttttgtatttttaatagagacggggtttcaccatgttggccaggctggtctcaaactcctggcttcaagtgatccacccgttttggcctcacaaagtgctgggattacaggtgtaagccaccatggctggcctataatatttgatttaaaaagaaaaaaatagctgttaagagcaaaagacaactgtagagggagtaaaaaggggaatttggaaatcaacaactataatcaaataataggtctgctttacctggccatggacaccagtctcatgtgttccctataaattataaaagtcctgggccttacggatttatttttaaaaatctttttttttttttttttgagatgagctctcgctctgttgcccaggctggagtacaatggcgccatctcagctcactgcaacctccacctcccaggttcaagcgattctccttcctcagcctcccgagtagctgggactataggtgcctgccaccacgcccggctaatttatgtatttttagtagaggcagggtttcaccatattggccaggctggtctcaaactcctgacctcatgatctgcccacctcagcctcccaaagtgctgggattacaggcgtgagccactgtgcccggctgctaaaaaaatcttttatttgattttttatttctagaacttttttccccaaattgctatggggttttaaagctgcctttcaggaagtaaacattttgatggtaacttgtagatttaggtcgagattctaggacttaatctccactgatgtagcaactcaccttggaggatttttgaggttccgtgagagcccggccctgaactattccactgctgatgtaagaaattccttttagtggactaagtcagtcattctgcagttggagtgaaagacttaaaatataaagtacatgtgggagggataacacattatactgagccatgaataatacctaatccttttctgagagaaattttaagaaatcaaaggagcaaatcacacacagactgcttgttaacaaaaataagcttcatccaataccaagttttagcacaagtcaaactgcactgaaatgtagacatgttaaatattattgtattgaacatgacaatctctgtgtaccagtgctttttcctcttcagttattctgatgggttttgtgtgtgtgtgtgcatttgtcctcccttctcaatttcctcttatgctaataccaccttccaatgcatttctctcctcaatgaaacatggcctttaagccagctcattatctctccctccccaaagactcaactcatgggttactagctcttaaagcctaaccagtagcttctacttgcctgtgtgcatgcaaaaaatatctgattttcaatgtgtacctagatggattttatttgtagagtatacttctattaaaggagaaaagcaggccacgtgcggtgactcacgcctgtaatcacaacactttgggaggatgaggcgagtggatcaactgaggtcaggagtttgagaccagcctggccaacgtggcgaaaccccatctctactaaaaatacaaaaattagccgggcatggtagtgggcacctgtaatcccagctactcgggaggttgaggcaggagaatcgcttgaacccaggaggcagaggttgcaatgagccaagattgtaccattgccgtccagccgaggcaagaagagtgaaactccgcctcaaaaaaaaaaaaagaaaaagaaaaaggaaaaaaccaaaacaatgtaccagatcccaaaatggctatatgtcagttacagtgtcatcagtaattgtcctcatctaatgctctacagattttctatacatctagatttcttctcattatactttactatgactatgatgaaactaactactggatcttaaatactcctaaaaaaaatttttgaacattcaatgtgctttgaaaaagaaaagctaagcttttatgagttaagtgaacagcaataagaatgaaatttctaggttataataaaatggttagattgaaaaatcttttttcattgttttggactgcacagaatgcaggcattttgtattgaagacatctaagtgcttgatgaagaattttgaaatagccaaagaggaaagcttaaacatcagtttctccaaagattgacttcatctaattaaaataaataggtaaataaataaaactggaaaactgttacagcatttttaggaaaatgagtccttactctacacaaaaaagagaaaaatgcattatggaagattccaagtatgtgaaacttttacagataggttgtcctcagtgaactttctttttctccaactgtaagtgacccattcaccaattacctgtctattccacccatccatagagaggtgggggtgggagtggctcagctgagctctagccagaatgaaagtagggtggctgactagggaatggatgggaagaatgcccatgggctcaagcagggaactgtggggaaggatttcccagttaggaattaagccagataaaggaacatatgagttaaggagctgttgagctatatagctgggatttttttctacgagaaaataaggcatctctgtaacacagtcaatagggtgattgtcacatattttaagaatgagattttttcgccgggtgcggtggctcatgcctgtaatctcagcactttgggaggcctaggcgggcggaccacgaggtcaggagatcgagaccatcctggctgacatggtgaaaccccgtctctactaaaaatacaaaaaattagccgggcgtggtggtgggcgcctgtagtcccagctactcgggaggctgaggcaggagaatggcgtgaacccgggaagcggagcttgcagtgagccgagatcgcgccactgcactccagcctgggcggcagagcgagactccgtctcaaaaaaaaaaaaaaaaaaaaaaaagagatttttttcccatgtggtctcccatggtccagaaagaaaccgatagacggacataatggtgaagctgattttggctgtactaaagtaggaaatctgatgattagaagtagccatagaagataatgagcttttcttcacaggaggtggtgtttagataaaactggatggctcgctataaaaagtatgcaagcactgtattagaaggttgaaatagagaaccttcttaaggcgttccagccctgaaagtgtggcactctgtgaaatgccgacccagttcccacacaggttacacaagcctgggtattcactgaaaagcagaacatgacacgataggatcataatggagttcactgaacactgattagaaatggtgtgaatatatgtttgcctccaactgagatttcaactgaagtttcaaaattattaaagccttttaggatgaagagtcatatcactaaatttattagttccaataactgaatttataatgaatattattattgcaatattacacataactttagtatttttctttctatagtgtcaaacagttgccacactacagtccataaatggcaagaacataggttaaaaattgctccaatttttttttttttgagacagattctcgctctgtcgcccaggctggagtgcagtggcacaatctcggctcactgcaacctctgcctcccacattccagagattcccctgcctcagcctcccgagtagctgggattataggcacccgctaccacacccagctaatttttatattttttagtagagacaaggtttcgccatgttggccaggctggtcttgaactcctgacctcaggtgatccactggccttggcctcccaaagtgctgggattaaaggcataaaccaccgcgcccagccacaaaaaattgctccagtttaaagtggtgcataaaagtgaaatcagagactttagatctacaagtataaatactgtaatgcagatatgtgcacaaatttttcactagtaggagaggctaagttactccacttgtttagcagtctgcctcaaaaccagaagcccaatttatctctgctgttaaaaataatcttgacctgaaacttatctttttggaatacttctagttaccttcagaattgggctcactttcaaaactgaagatacttggactaacaggaaatgagttcctttcctttccggaggaagtcctttctttagcgtctttagagaaattatacattgggcaagaccagggattcaaacttacctatgtgccagaacacattaggaaactgcaggtaagcctccccaaatgagcaggctaagaagcacctgtcactgcctcttaaattggctgaaactgagaaaatatgaggtctccacaggctggatgtagaatcatccatactagatttccagcttcagacaagcaatcatttttacattttgaggtttccactgtccgtgaacaactcttcaacatttcattgtgattgctgttggatatgtcctgccatacttctttccactgtgtgatttggtgtgtttcatttgcagaaattgagtcataactctttccatttaatttccactttttataagtagccccctgaaaactggactattttgaagttaaagagtatcatacaagtgacatgctgggagcctacattttggtgcccaggatttcctgtaaggggaagtgtgacctctctccctgattggaaaagggaaatcatgttgcaccagcttcctggatctgcagggctgtgaggaatacttgcaaagcaacaggataacttcattcaaagtagccatagtagggtgtcttcatatattcatcctttaaagaactgttttttttttttcatgttcctgttgctgcacttttttttttgacagagtttcgctcttgttgcccaggctggagtgcaatggctcactgcaacctccacctcccgggttcaagcgattctcctgcctcagcctcccaaatagctgggattataggcgcccaccaccacacctggctaattttgtatttttagtaaagacggggttttgccatgttggccaggctggtctcgaactcctgacctcaggtgatccacctgcctcggcctcccaaagtgccgggattataggcataaaccaccgtgtctgacctgctgcactcttaatgatgataaagtaggcgtgggccaccacataaccccagtcatgcaatgccatgcacagcataggtagttctcactatgacacagggtgtctcttcctaattctccattcctttgccctgtgttcatagaacacctttcatcagcttttcctttgtacctgtcatgccacaatcttagggtgaagtacaaacattagatttttgcccagtgaagttgaaaatagttattttgaatacattcaaatccattccctgtgcattttggctactttcactgaggcaatattgggttgatagttgaggcaattatcattctgtagcaactgccacagacaattagctattaaaaaaggagttaatgataaatgtagttaaattattcaaattatttttccataaagttctggtgaaacaaataagcactagatgtctgtagtctcttttccctgcataaatggaaactaagtctaatggatttactcaaaaataattttgggtcttgatgatggtcctttagacatgctttttcccttaactcaatgcgtaatttccccactgaaagtgaaaaaaaaaaaaaaaaaaaaaaaaaaaaaaaatgcatgagcacccacaggtgattctggttattataattaattaatcaaggtatattattatggtacactcatgttatttcagagtctcaaagagctatatatagagaacaatcatctggagtacctgcccgtatccttggggtcaatgcctaacctagaagttcttgattgccggcacaatttgcttaagcaacttccagatgccatttgccaagcacaaggtgaggaaacttagtagattcacagcctagcagagtttgtggccagcatttcctatggcaaatggcttccttgctttgctaaagacctatctcagtgttcagagaactgagtctatcccattacttccttgcagggctcacttagcgacatgggggaggccaggtgtcctgattagtatagctaagagtcttgcaaaggcagttaagtcatttattaaaatggaaaggtaaatagcgactgctaagaaaattagcatttacccatacatttattacactaccaacaataatttactgtacacttactacatgccagaatttggagttgggatcctgcagtaaatttcatctaggtcacggagtcacttgagtaaaagaaaaagtattggcccagagtggtgaaattagcaggagactttcttggagctacataattgacctggaaaactatatatgattcctacttaaatagccaaacattttccactacactaagccattctttgtctgtacattcatccatccacttaatatgcttttgctgagcacccactgggaccagattttaaatgtttctttttttttttctgaatcctaggcttatgcacatgttttcaaactatggctattcttttttttttttttttttttttttttttttaagacagagtctcgctctgtcgctcaggctggagtgcagtggcgtgatctcggctccctgcaaactctgcctcccgggttcacgctattcttctgcctcagcctcctgagtagctggaactacaggcgcccgccaccacgcccggctaatttttttttttttttttttttttttttttttttttttttttttagtagagacggggtttcactgtgttagccaggatggtcttgatctcctgacctcgtgatctgcccaccttggcctcccaaagtgctggaattacaggcgtgagccaccgtgcctggcccaaactatagttattctttaatgaaaaaagaatggagagagtggaagctgatgcctactcataaggcattcaaaaactgggggcaaggccaggcgcggtgctcacgcctgtaatctcatcactttgggacgccgaggagggcagatcacctgaggttaggagttcaaaccagcctggccaacatggtgaaaacccatctctactaaaaatacaaaattagctgagtgtgatggcacgtgcctgtaatcccagctacttgggaggctgaggcaggagaattgcttgaatccgggaggcagaggttgcagtgagctgagattgcaccactgcactctagcctgttaacagggcaagactccgttttaataaaagttaaaaaatttaaaaaaaaaaagaaaaaaaaaatggagacaaggggttgtatgcagtaatccttagtaatgctcctgaccataaatttttatcctgtccttggtccctggaggagtgaaatattctcaaaatttttcagtgttttctatttttctgtctctaatatttatggacactggcttcaacaactttgaattgttataaagaagttgtaggccaggcgcggtggctcacgcctgtaattccagcactttgggaggccaaggcaggcagatcatgaggtcaggagttcgaaaccagcctagccaatacagtgaaaccccatctctactaaaaatacaaaaattagctgggcttggtggtgggtgcctgtaatcccagctactcaggagaatgaggcaggagaatcacttgaacccgggaggcggaggctgcactgaaccgagatggcgccactgcactccagcctcggtgacagagctagactctgtctcaaaaaaaaaaaaaaaatagccaagtgtggtggcgtgcacctgaaatcccagctacttgggaggctgaggcacttgaatcgcttcaacctgggaggcagaggttgtagtgagctcagatcatgccactgtactccagcctgggcaacaaagtgagactctgtctcaaaaaaaaaaaaaaaaaaaaaaatcaatagtctgctgaccttaggaacagcagggtctgagagtgatttttcccagtgggctgtcagtttcagctaaaaactgttgctctaaacaaacaaaacatttggaatatctggagactgaattctgttctcttcattttgagaaggagcaaacatagagctagaacttttattagatggtagaaaaagttttgtcgggtcttgtgcatccttcctctcattccctttgcaaatgcagaattggatccctcacctatgtggacaggattaggtgacaagttaatattgtttcttctaagattgaaccaccattacgaaaaaatcttttcagctttgaaagaattacggctggaggacaacttgctcacccatcttccagagaatttggattccctagtgaatcttaaggttctgacactgatggacaatcccatggaagaacccccaaaagaagtgtgtgctgaaggcaatgaggccatatggaaatacctcaaggaaaacagaaacaggaatataatggcaacaaaggtaaaatcagcccagattcttgataacagttgctttagagggagtctaatggtaaacacagtacagattatcctacggagcaactccttacacccttgtcctgcttctgaaaagagaagttacttggtaacttttatgtccccagggctaagtaagaagatttttaaatgtcagccctagcatttttgtcttttatgtcccttatttctttgtccaataagaagccaacaaataggcaaaggaaaccaaaacttcaacatttccaacaatctaaaattcgtggactatttcattggaatgaaaaaagtttgtattaacaaaagtagtaaaataagtttagaaaattagaaatgaaagcgtttatagatgagaggctgagcccagggttctgagctgccattaataaggatcaaaaggctgagatccttgtaattctgctctagccctttgagcccatggagatgtaggacaggtctggaatgtgtccacttcagccagtgttctttattctccaactggcccaagtccccatcatctcacagccggataactacataagccctctgactactgtccctgcttgcatgccagccccccacaacataccttctgctcagcagttgcactgatgctccactgaaattggcaatcctccattacactcagagtaagagtcaagtcttcagtccgtaaaaccccctctcaatagccctcaaccctatcagacctaatgtcctcccttttatgataaatcttttgtaatacctcttttactattccaaaataaattcagagataataaaaacatacaaaaggacataattttaatcaaaataacgcctgagttacaatttaaaggagaaagaaaagtaatttatatacaaatatatatttcaggcctggcgcggtggctctcgcctgtaatcccagcactttgggaggctgaggcgggtggatcacttgaggtcaggagttcgagatcagcctgaccaacatggtgaaaccctgtctctactaaaaatacaaaaattagctgggcatggtggtgcgtgcctgtaatcccagctactctggaggctgaggcaggagaatcgcttgaacccaggaggcgggggttacagtgagcctagattgtgccactgcactccagcctgggcaacagctgtctccaaaaataaatgaataaattatttcagtgtgtatatgctcaggatggattacacttgaaagaatgaaagttgtggttcttaattgaatacttcctaaaagcattttgaaaaactgtgcaccctcttgcacgttcttaaaatgatatttaacattgttggccacaagtttaaatcattgcaaaggatgtaatttccagtgaattttaaatgttgacattttaaaatagagctgttagatcaatattttaaatgtatccagtggaaactgaatatcattatgatttgtcaacaccaatttacaaatactcaaacaagttattattttataggcagaatttttatatcatattccttttcttcttaaacatgtacttccattctactttcccctcaaaattgatcctaaggttttatgtatacacatataagtctttcatagattgctcttttgtacttctaggtgacaaaaatatttatataaattaaattttaaaaatttaaaaatgtatatacattacaactattagtataaaatcacctaaaacaacataaaatttcttacaaattttaataattattagacatataggattttttagaacagtgtaccaaaatgagagggtttttttagcatagtttatatattcatgcataaatattgatgattattagaataacacagggttgattatagattctactcctgtttctcattttacagatgaaagccttgagaaaccttgttcacgtagatgagttaaagagaacagaagaagctttttttgcctgtaatgttttattttaaaaaaacaatgattcatgcatctctgagcttcttccagatttatatcccccaaatcgatagcaggtcttagctgacatgtcaactaggcttcccttatttttcttgaaggtagaattagaaaccacctgtcttgcaaaaggattggttaaccagtccctagagtcattcattttctcatcaacacttgtactttgaattgtctttttctgtgtgtgtgtgtgtgtgtgtgtgtgtgtgtcctaatgatttttggagtccagggcaatgcaccatagtaagattcaggtgggtgcaagctgtgcccttcctctgtggagcatcacaggggcaactgggatgggggatctgcagttatgttctcgggatgattttaggaaggggtacatatggaagctggagctcaggaaatggactgtcttcaacctatccatgcctgcacactgttggaaaggctttgtagaccagggtataggccacacaattgaagactgcttaaccttaagtcaacaaaaagccccataaatttccaaaatgcctctagagagcagtgctgttccctggatcccgattggtctgctgttttcactccccatctcctctttcctactctcactggacttcagtcacaagcagatctggtgttcctccaaggaccaagcatgttcctggctcagggccttaacactggctcttcctgtgcccagagatgctttccccagatatgagcaagattctggccctcacttcattccatctctgcttaaacattctcttatcagagagcccttccttgatccaccttatataaaacagcatacccccagccacctctttcatttgttcattcattcaacaaacatttattgagcttctactatgcaccagacactgttctaagcattgagatacatcagtgaacaaaacaaatatttatgtcctcacagtacttaaaatctagtaggagggaaataaaagcatgaaatagaaaacataaaatgaaatactatgttagagagtgctactgtttaaaaaaaaaaaaaagttagcctaaggggaactgaaattgccagtagtgtgtggaggtggagaagtggttgatttaaataagattgtcagagtaggcctcactgaaaaaatggcagtcttagcttaggctgccacaacaaaataccatagaacaggcggcttaaacaatggaaatgtattttctcacagttctggaggctggaagtctaaggtcagagtatcagcatgattggagtctggtgaaggccctcttcctggcctgtagaagctgacttctccctgtgtcttcatataacagaaagagagagagagagagagagagattgcactagagagtgctaactctctgatatctctccttataaggccactaatctcatcatgaggaccctgctgttatgacctcatataaatctaatcatctcctcaaagccccttctccaaattcattcacactggggattaggacttcagcatatgaatttggggcaacacagttcagtccgtagcaatgacaatcaagcaaatccttgaagcagcggaggggtgagccatctgaatactgagaagagttccaggcaaagaaagcagcgaatatacaggccctgagtcacaactgtgcctatgtgtctgagcagggaggaggcccgcatggctggagcagagtgagccagggaaaagggagttaagaggttagaggggtcaggattggggaggcagatcagagagggccttgtaagccatataaggactttggcttctattcagagagaaatggggagccactggacaagtctgctgctagaggaagggtgttgctgggtaggtaggagggaataggatccagggaacaagtgagggctggctttaggcaggagcacagacagcccagtaaggagcaggaaggcagggcgtaggcactcagatcccctcaccatgtgcggtcactctccatagcactcatcaccgtctgacaaattgaacattcatgtgtttattttgtactgtctcttcctcactggaatgtgagctccataaagttgagacagttatttctctgctgttgcccaaaagtctagaacaggcactggcacataaaaacaataaatgcattttttaaaaaatttgtctgaatgcctagccaattgagaaagatagaaaataaaatttagagttctaatcacatcccattctctccacgtcttcaagaccatgtatcagaataaagagatttaacaatttccagttcattgtgataccagccgatgctgaatttgggtttatcttgttttcagattcaggcatggtggcgtggaacaatggtacagagaggatttgggaaattcggtgaactactaaaaccacaaaagaaaggaaagacctctccaaaagataagaaaggaaagaaggatgtaaaaggaaaaccaggaaagggaaaaaagaaataatcctgtaaattgataaattggggtaatggaccttgatagattaagaagacaaaatatctaggaattagatgcctactacattaaaattattcataaaattacacttatgtgtaaaaataaatgattcttacttttactgaaatatttatggataaaatgatataacaccttggaattgcttctaaataatatgggagggggaggggaaagtgggtaggaatacaagtgaaacaagattggccgtacattgataactagaataaggtgatgagtacgcaggggttctttatactatttgcctacttttatttatttatttattttaagacaggatctcactctgttgcccaggctggcatgcagtggtgcaatattgggtcactgcaacctccatttcccaggttccaacaattctcatgcctcagcctcccgagtagctaggactacaggtgcatgccaccatgcctggctaacttttatattttttttgtagagatggggtttcaccatgttggccaggctggtctcgaactcctgacctcaagtgatctgcccgccttggcctcccaaagtgctgggattacatgcgtgagccactgcacccagccagcctacttttaaaacttttactgtgaaataattatagattcacaggaagttccaaagaaatgttcaggtaggtccaggcactactcagcctccctcaacgctgacctcttttataactatagcacaataacaaaaccagaagattgacattggtacaatcaacagtgcactcatttgtgtgtgtgtgtttgtgtaatcctatgcaattttgtcacatatagttttgtgcagccaccatcacagtcaagacatagaattgttccattgccacaagtttcccttgtgctattcctctgtagccatacctactgcctactcctctcccaatgcctaacttgttctccagatccataattgtgtcattttaggaatgtcacataaatggaaacacacagtttgtaactgggattggcttttttattcagcctaatccacctgaagtctatcgaactgggggcatgtatcagtggtttgttcctttctgttgctgaggagtattccatagtcccacagtttgtttaacctttcactcattgtttctagtttttttgctattgtgaacaaagctgctatgaacattcatgcataggtttttgcatatgcatagatactcatggaatgcatgggaatgctcatgatattcatggtattcttttatatcatgtaacccaaaatatcccctttacatcattcaaaacctcctcatcctgaaaaccttttaatttggagtagtgttgattttacatttgcatgtctttcaggcagtgattgcaatactaattattagtgtagtagaagaaagcaaaacataatttgactagagcttgtcagaatagaaatgtgcagacaaacatctctgccatgcaatgactttcatgctctagcaaaagaaaatcaaaaatttcaaaaatagtttagagcaacacaaaactgtcattaacgaattaaattagttttatgaagcaaattccatttcaaagaaatgcctggaggcaatatgttaacaattttttaaacaataaaaggttttaatttattctaacaagatatgtttttcatactgagttttagatttttaatcactttttactaagatttatatgtcagtgactatcattactgttcatggtttatatctgagataaaaggcaccagaatataaaataataaaccatagaaaggtacactttctgataaaaacctacatagactacattaagatacatatagtaatagtaatgatacatgaaactattagacagctagtgcctttcacattagaattacacacacacacacatacccctttatatttagaacatttaacttgtaggaaaagaagaggcaaaacatttctgggcaagaggaaagcagttgcagtaccaaaatctaaacacttttggcaaggcttctaaacagcaaatgaactaattatatatccaaaacaaatccattgaaaaatgccatttttgtttcatagacagagaataatggcatgctcatattagatattatatatatatttacatatatatgtgtattatatatgtatattatatatatgtgtatatatgtatattacatatatatatgtaatatatatatatatttacaaagctcttgtaatataagtcccattaaatggcccagaagttgaaattcagttcatgactctggaattcgttcatgttcttttcctttggagaatggtttgtagcttagtaggacatgggaaatcagtttactgaaacccaccatggtcaaagtgaatgcttctttttttatcttggtcaaagcattctagttcttcctcctgtgaagctgggagaatccatcttttcattcctatctcagtgatctgaggaagcttggtcacagcatataacaagtgtctaaaccattgtccacaatctcgaaaatttgatggtcgaaggctaatatccagctcgattagctctttgaggaaccgcacgttttggcagaacatggtccaccccgcatcacagatgctgtcattgtagctcaggtccagcttttgcagtttggccagatgacccgtctgtatgaccgatgctggaaaacagaatcactctaaatgctaacatacaagaatactgtctgccatggctattcccatttcccataacactatctccaggaatagtaatgacaagattagtaattagtaatgatttgttattagcagctttattcaggacatctgaaattagtaacagatttcctctctgtacatcccatctacagctttttttatttctttttccaaatctcaacccaataatttttttttgtcaagttcctgctctctgttccactgaagtccgagctcttcctacagattttctctaattaaatgtaaagagtgatggctcattggctttaactaaggaccatttgtaaataatcatcttgctgctttaattgttcattttcattcattcagtacttcttcatccagcaattatttaaatgagcattttccatatgcagaacatacctggataatttccaattcaccttagagaccccaatacatgtgacagttttccttttgaatagaacatatcagtactacctacaatggcacttaaaaatgatgactaatgtacaatctgagctatttgatcagaaaataaataagttaatgatgaaataaagacttctgtaagaggaggcaggagagataaccacggaaaatgggacatgcttcccttttcaaccaaacccaggaatggattgcagagatcaggtgggttgtatagaatctcagcgttgcaagggatcttggaagtctccttatccaacctcctaatcaataatcagagagaaatccttttcacagcctctctactcatgaccaccacaattctggctgaactgttctttcaagtttgccccagcattatggagcagctcctagcgggaggaagccctcccacagggccccaatctatcttctggtgtctttcacccagtgccccaatcagtcagctgtaacattcagctccttcttcctcctggcagccctgcagtgttggacaacagccaggtctcccttaaactttatccctgtaggactgaacatgccctggtctttcagtctttcctcacacgcatggctttcagatcaaggaggatgctccaactccatcactttcacttgccaacagtttgattccacagtgaatttgagagctcagccacccgtgcacacaacagctgcactctgtctctaggtgttcatgtcagtgtgtgtctcccttcctgtctcgcaacattaatcataatattctcaagacctaactgttaaaacaatgtgcacgctttttctcttttaaaaaatgttgtattatgaaaattttcaaacacaaaaagtagagagaataggagaaagtggaccaccatgtacccatcattcaacttcaacattatcttcattacatcaatcttgcctcatctagtcccctttcttctacttttttgttttttaaaaacacattttaggctgggtgtggtggctcacacctgtaataccagcactttgggaggctgaggtgagtggatcaccaggtcaggagttcgagaccagcctggccaagatagtgaaaccccgtctctactaaaaatacaaaaatgagctgggcatggtggcgggcacctgtaatcccagctactcgggaggctgaggtaggagaattgcttgaacccaggaggtggaggttgcagtgaaccaagatcgtgccactgcactctagcctgggtgacacagcaagactccctctcagaaaaaaataaaataaaatacataaataaataaatttattttttgtttggattttataatgtgagcaccctattttattatattttattattttagatttattacattttaaaaaatctaggtaggggaaatgtaggccatgggtatactctttatagtttactgtatgaaaaaataaatgccattaattatttttaaaatgtatataagctagtgattaacaaatttttaatgtttctattagaaaaaatataaaagtgacaattgctaaaaccacatatagtaatacttgttttttgttgctgttgttgtttttgtttttttgagatggagtctgctctcttgcccaggctggagtgcaatggcgcaatctcagctcactgcaacctccatctcccgggttcaagtgatcctcctgcctcagcctctcgagtagctgggattacaggcacctgccaccatgcccagctaatttgtgtacttttagtagagacagggtttcaccatgttggccaggctggtctcgaactcctgacctcaggtgatccacctgccttgtcctctcaaagtgctgggattacaggcgtgagccaccatgcctggcctgtaatacttgttattgagtaaaaattcaaagaaggaaaatataccctgataaaatgtaaaagtataaatttgacctgagaaaaaaactgtcagtaaaaattaagaaaaaatatacaatggctgaagacatggtgaataaaatttgatgcagacaaaaataaaaaagaccgaaatgaagaagcaaattttaattataaacattaaataaaataacttaaatatatttaatggtgtctaattcagagaaataaataaataaaaatcaaaagcttattttttagaagacacaacatcaataaaccccttgcagtagtcagaattctaaatagccaccttaagatttccattgtatccccaggactgaatgtggtagattttgctcccagaattagcttaggctatatggcacacctgactttaagaaagggagattatccatatggagtcaacctaatcacatgagccctttaaaagcagagagaatttcctcctactgctggcagaagaggaaggaagtcacagaagtcagagagatttaaagtgtgagaggcacggacaatccactcctgtcttgaaaatgaggggccatgtatcaaggaatgtggctggcctctagtagctgacagcagcccccagctgagagctagcaagaaaacgggaccctcagtcctaaagctgcaaggtcctcgactctgtcaacaagaatgagcttgaaagtggatttattcctagagccttcagatgagaactcagccaggctgacaccttgattttagtgttgtaataccctacacagagaaccgacacaagctgtgtcagacttcttacctacagaactgtgagccgggtgagggatgagaaattacttaatgatgcattattcatttgggtgatggttacatcagcaccccagacttcaccactacaatatacgcatggaacaaaactgcactggtgcccctcacatttatataagcttttaaaaagaactgtgaacaaatacatggatattgttttaatccacaaattaacatgttacacagcaacagaaaactaatacctttggtcagactagccaagaataaagagatagaaacacaaattatcaatatcaggaatgagacaggtggtatcactatgggcagtaaaaggataacaaggaaacaactttatttccataaattcaacaacctagatgaaatgggccaatttcttaaaagacactatcagaacttgcttaagaagaaatagacaactggaatagtcctagctctattttttttctatctctattttttaaattgaattcgtaatttaaaatatcccacaaagaaaattccaagtttagatggcttcagtggtgaattctgtgaaacagttgagcaataaataataccaattttacacaatctttctggaaaataaaagaggaaggaacactttccaactcattgtatgaggctacctataccctcataacaaagccagacaaagacattataagaaaaccagtagactattatccccttgtgaacataggcacaaatatcctcaacagaatattagcaaataacatccaacgctatataaacaagataatacataatgaccatgaccaggctgatttaacattaaaaaatcagctaatattattaattattatcattcattattattatgaatattaatgaactatagtttttttaaatgctcatctcaatagatgcagaaaaatataatttgacaaaattcgttataagaactcttagcaaattaggattccttaacctgataaagggtagctacaaaaaaacctatagctaacatcatacttaatggtgaaaaatggaatgcttttccccttagcttaggggactaagactggaagcaaggcaagaatgctctcatctcattcaacatctattggaaatctagccagctaaataaccaagaaaaagaaagaaaagatacacagagataaagaaataaatctgtctctaggccgggcacagtggctcacgcctgtaatcccagcactttgggaggctgaggcaggcagatcacgaggtcaggagatcgagactatcctgaccaacatggtgaaaccccgtctgtattaaaaacacaaaaactagctgggagtggtggcacatgcctgtagtcccagctactcagcaggctgaggcaggagaatcgcttgaacccaggagtcggaagttgtggtgagccgagatcatgccactgcactccagcctggtgacagaatgagactccatctcaaaaaaaaaaaaaaaaaacaaaacaaaacctgtctctaatcatagatgatatgattatctatatagaaaatcctacaggatctaccaaaaatatcctacagctaacagatgagtttagcaagtttgcagtaaaatgtcaatatacaaaaatcaattatatatccacgtaacattgggaatctaaaattaaacagtatcttttataagagaacaaaaattaaacactcagatataaatttaacaaaatataaaaactagaaaacaccagtgaaagaaatcaaagagtacttaaatacagagatagactgtgttcatggattggaatactcaatattgttaagatgtcatttctccctgaattgatctataaattcaatgtaatcccaataaaatttccagatggatttttaaaatagatattgacaatctgatgctagctttaaatggaaatgctaagtaactagaataaccaaaacaattttgaaaaagaaacaaagaatacttatactacttcatttcaagacttactataaagtttcagcaatcaagacagcgtgatattggtaaaataagagacacagagatcaatagaacagaactgagagaccagaagtaggccatcacaaatatggccaattgatttttcacaaaaatataaaggcaaatcaatggagaatggatagtcttttcagttaatggcactcaaataattggacagtaatatgcaaaaatattaacctctacccatacctcataccttatataaaaattaactcaaaataggtaataggtcaaaatataaaatgcaaatacaaagctttaagacaaaaatatggaaaaaatctttgagaacttagatttgcaaaacgctctaagatgcaacacaaaaaaactctattcatcaaattaacaaattgataaatctttatcaaaactgaaagctttgatctgcaaaaaaacactatcaagagaatgaaaaagccagtgggacagacccagagaaaataatagcaaattatatttctgataaaggacttacttgtattcagaaaaatctaaaaaactctccaaactcatcaataagaaaacaaacaatccaattttttaaatcaggcaaaagatttagaacagacatttcaccaaaggagctaagaaatgaaaatacacacataaaaagatgtttgacatcattggtcattagggaaatgcgaattaaaatcacaatgttttgtccccatcttctaattacaatcatttttgctataacacttgttttgaaaacacaagtttatttcaatgagattgaaatgtcaggaaacaatctgagtataatgcaaatttcttgtttgcattatgcacacaatttgtccacaggaaacactaggtgaacatataaaactgtccccagctgaattgagctgcatatagaaataaacagcctgggcacggtggctcacgcctgtaatcccagcattttgggaagcctaggcgggtggatcacctgaggtcaggtgtttgagaccagcctggccaacagggcgaaaccccgtctctaccaaaaatacaaaaattagccaggcgtggtggcatgcctctaatcccagctactcaggaggctgaggcaggagaatctgttgaacatggcaggcggaggttgcagtgagccaagatcatgctacttcattccagcctgggtgacagagtgaaactctgtctaaaaaaaaaaagaaagaaaatgcagacatgcacacacctcatgaggacaacaaccctcatctctccacacaccctctttccaccaatggaagtgtggacaggccacttctacaaacttcaggtctttctcgggaaaatgtaatatttgctcatttcttaactatttaatatgtaaaactgtattgctatttttcatagcttctgttttttaaaatatgccactgatgaagtgtttgagtgcggtgcttccaaccgtaagtcctgtggttattactgaataattcttgcataacacatgatttttaggcccatgtgccgtgtcatagcaaaactgactaatatatacactgagaacacagatacaactacctggagtgactgttctggcccttcattgggaggcgcgctcattgctttggaattccggctgaatagtgattggagtgtggggacaaggctagatgggagccagagagagtactctctgattcattgttttataatgggaaagtggaaacatagaatgagttttttattttgttttgttttgttttttgagaaggagtttcgcccctgctgcccaggctggagtgcagtggcacgatctcagctcactgcaacctcggccgcccaggttcaagtgattctcctgcctcagcctcccgagtagctgggattacaggcatgtgccaccatgtcctgctaattttgtatttttagtagagatggggtttcttcatgttggtcaggctggtcttgaactcctgacctcaagtgatccgccagcctcggcctcccaaagcgttgggattataggcgtgagccaccgtgcccagacacataaaatgattttagggaatatttgggtagcctcaatcccacagtgcaaaagttattccttattcaattatctttccatctttctagactgacatggaaaaagggtcagattgttactacagtatgcctttaaccctctcatctttttctaatagagaggagcctctaatcaaagccatcagcagtctagtatctgtgagaagtgatacctgtatttcagttacagtgataatcagtttcctgtttaaataaaagcatttaaattaaagagtcaatttaaaggaaaagttaagcaatagtgctggaaccatgtggatgggtgagatgtagatgactgaagtgggaacactcacggaccgcggaggtgtggaacagagctgtttgcctttcaggaacctccccacctatctatatccatatccttttaggaaatgccttccactgtcatgtggttttagaattgccttcgctcattttaattagacctctcggcagatgttggtgagaagggaatctgcacagagggcttcaccccaggtctggtacctcccccacctccccacctggtgctttgcaggggccgcacccactgctctgtttgccaagaccgcttgggaacaagtagatacacacccaggagagccacatcctctgtcaccagggaacagctgctcagcctcagcacttgaagagacatggaaagctttagtgtttccagaagcagcttcaagttgccaccaacacacttgttccaagaaaggttgaatacttccagagcagagaggtgaacagaggcttcagctaaaagtgataacaatacgaacagcagtaatttaggatttcttacagatcataggctttggatttgaggaaactggtctaggacaacacatgaatataactggggttgagaaagttgtagagaccattttcttctgccttaaatttatggcctcaatttatgttgtctgttttttgttttttgttttgagacagagccttgctctgtcaccaggctggagtgcagtggcgcgatcttggctcactgcaacctccgcctcccgggttcaagtgattcccctgcctcagcctctcgagcagctggggctacatgtgcgtgccaccacacccagctaattatttttgtattttaatagagacgctgtttcaccatgttgcccaggatggtctcgatctcctgactcaggatccgccagccttggcctcccgaagtactgggattacaggcgtgaaccaccgcgcccagcctgttgtctgtttttatttggggaaatattggaaactttagcaatgcaaaacttgataaattggaattcactgtccaactggggtttctttccttcacttcacatgtaggaaggagaaagaggcaaagtgcttggacagctagtcaagatttccagaatgtgtcctggttggtacatatttcactgcacagtcactgctgagattcagatgggggcaagcctccctcagagtctgaaataccaaaacttatttgtatttacttcacgcaattactgcaggcaaggaaagtaactaatgtattttggaaagatttttaaagaaaagtaaaagattttctgcttaattctcagttgcccccaatgttaaaattaaccagaatatcttattcccaagttaattgcactttaatctattctgccttccttctagaaaataatgtgttcaaggggaaaatatatatccttttataatatctagtaagaaaatccttacagagatctacattaaggagaaatggaactttttcttctaaaagtgatgtagggaaatatatatttgcttcatttacttaattcaaattgaatggtagatttatgtcagatgatataatttagtgtgatacctagttgatcatgattcattgattgtgcagctagaattagaaacagctgtgccttctaatggctgcaattcctttaaaaaaaaaatattttcccagaatgggcaacatggtaaaactctatctctaccaaaaatacaaaaattggccaggtgtggtggcatgttcctatagacccagaagctactgaggaggctgagatggcataatcacttgatcccaggagttcaaggctacagtgagccatgatagtgccactgcactccagcctgggcagcagagcaagaccctcccaaagtactgggattacaggtgtgagccactgtgcctgacccaagtccacggttctctactgggggttagtcatctagctaccctccgctcagcatacaccaaaattccatcctcacaaaagaaaagctcatgttcagcataaaccatgttgtctgtgcaaacaggttaggcacagtaaaccacccttctcagttaggaaatggtatgaacacccccagattccaagttctgggatattagctaagggccagccttactggttgatagcaggcctttacagggatagcagcatcaggcctgctacgttaactcttttttgcccccatacacgtgattggagttgctggatttgggtgcttcctggataatgctaaaaacagagtccttctctccaaccctctcaccagtgttttttatcagttggcacttccttaaaaatgaattgtactgtccaccagacaagggctattattaatgaaataaatgcattaaattcataaaaatgagtaattattattatacattaataaaaataaatgcatattatttacccccaaatttgaagaactctatatttagggcattcttgccctccttttcggcctgagtatttggctcagcctgagtattttgctcagctcgagtattttgctcagctcgcatagacttggtcctcaccatgtcctgctcccagcactccctcagcatcattcatcccattgtccacatgtctggatggggaaaagtcccaggatacgtagccttcagccctgctgttctagggcccatggacccaccagacaagtctaggtatgcttgaaggggtgcctgtgagctccctaaaactgattacagttattctgtggggaagagtatggtacattttctgtatgcaaaacatctggaattagacttcctgaaatcaaatcctgcctctggctcttatgaccttgggttacctcatgtacttaacatctctgtgcttcagtttccttgtctgcaaaatataaaatggaacaatggcacatgccttatacagttataagagttaaattggtgaatgcatgtaaagttcttggaaaggggcctggcacataggatatgctcaataaatgtcagttgttaagttctgcccacttggtgacaagtgcagtgtcagcaagtaagaggagatattttgaaacaaagagacttggtagcacttttccaaatccatcacccagggaaacagtagtttgtgcacacagtgctggggtccccaacaccacctccctttacttgctgacactaaacttgtcaccaaatgggcagaactttcagattcagtaggttcctgatgtaggctggggtatatctgtgaccttaaggcatacccagattcctcagacagcacataaatcctgttgggagtgattgcttggcagttagctaggctcacactctagtaaatggctcactttcccatcagatcccagatcctcaccatgtcctgcaggtgggcatgatccaccaggagggtggatcacttgaagtcaggagtttgagaccaggctggacaacacggtgaaaccctgtctctactaaaaatacaaaaattagtcaggtatggtgacgtgcacctgtgatcccagctactcaggaggctgaggcaggagaatcacttaaacctgggaagcggaggttgcagtgagccaaggtcgcgccactgcactccagtctgggtgacaatctgtctcaaaatacaaacaacaacaacaaaaaaaaccctgcacatactagaatcatttttatggactttcagaaggtcacttttaagaaggcatatgtcctgaaaagaagacaaattagtacttcgcaaactggctgagccttggaatgaaatgcagggaaaaagaagtctccctcgcacattattgcatggttcctgcagggatctgggaaatctcttaccaagagctgtaaaagtctcactctccaaagcacagttgttgataactaatgacttcaatgctggtaaaaatcggagcctgctgagtaagttttcagaagaactgcccatctttttgttggctgataaatccaattcttgaagatttgaaagtaaaggaatgacctgggctgttaaaaatatcaacagtgacatgttttaggcaccatctcacagggagtcttctgggtgtttggttcccacaatctgtttaatctgtcagtcaatacagctctccccaccccggccctccctcctttatacaccccaaaccagcctcttcccagcatgctgcttgggctttcttacttccaagccccttttcaggctagaagagcaaaggctgtggagacagagaagtagatcttggatctgctactaaagaactgtgtgattttggacaagttaattaacgtctctgaaccttagccttctcaactctaatactcttagccctctcggcagggcacagtggctcactgcctgtaatcccagcactttgggaggctgaggcgggtggatcacgaggtcaggagatcgagaccatcctggctaacacggtgaaactccgtctctactaaaaaaaaaaaaaaaaaaattagccgggcgcagtggcgggcgcctgtagttccagctactcgggaggctgagacaggagaatggcgtgaacccgggaggcggagcttgcagtgagccgagattgcgccactgcactccagcccgggcgacagagtgagactccgtctcaaaaaaaaaaaaaaaaaaaaaaaaaaaaactcttagccttctctatttcaagtggtcattgggaaggtaaaatgacttggtaaaggtaaagtgcttggtatagtgcctggcacatactaactgctcaattaatgtttgaaattataattcttttctcagaatgtaagtaccagtaaggcaatgaaaacaagccatcagaacagacacctattggtaacggcactgggtcctgaggggcccagctaggaattaccctcgttcgctatcttttggctacttctctggcctttgccccaactattaccaaggcagaaaatgcagtatgctggatctctacaaagctggcttacctccttgaagccttccagggtcacccacaccaaagtaaccccttggtcactatcacatcaccatattttattttcacagcacccagcattatgtgatattttcttgttgatatatttgttttctgtcttccctcactaaaggcaagctctgcgttataggaactatctcactcccagaatgggaatcagtacctgaaacatcagaggtacaaatgtttgtgggagaagggagagaggtcaggggaaagaaaggggaaaggcagggaaggcagatagatgggcacttgtaaagtcaacaggtgtaactatttctccctcttccaaccccctcagcactttgtatttcaccatgtagtttgggtatgcatcggtttactcctgcccttgccataccgaagctccctgagagttgggattttctgtagcccctggcacggtgccccacaccattagaggattcatcagtagttattgcttaaaggatctataattccatttctttggagcaatttacaatgatcggataaaagaatgttcaattatttaacagcgtaaagtacaaagcaggatgtattttcatttccatcttttcagaattaagcagaaggaaagcaatgcaattcattacagttatcaaataattattagttttccagggccattcacccatgtcagtggctgtgaacctaggtaaggaaagcttagtcctccgttatactagtgggaacaattgaggttctccagcactgaggagcaaaatgagatgtggtattcatgttatttagttgtaccaagggaatctggtgggctaataactctgaatgtcttcctaggtatgacgctcaggctatgataagtaaaggggatggtaggaacccataatgctccacgcaaagctcaaaaagggattattttgtcattttaaaatcttcatgaaagtcttgaattcttcccattttcccaaattgagagataagagtctgaaagataatttagcaggtttaaaaagatagatgtattagacctagaaacatattttacggtcttcctccccaaattgtactataaacaaccagaaacttacttttattctcattgtacactcattcattcattcattcacatattcaacatgcatttacttggtgccaaccatgtgcaggtgcctgtgcttgagcagtggggagatgccaaacgagacacctctagcctggaattgcccatgacctggggagagagagcatgggcaaagggcccaaggccagagcatgcctggcgtgtctgagaatcagcaagggcagtggccagggtggagtctgtgaggaggagggggagtgaatgaagtcagagtgttagaggacagggagaccatttgggctcttgcaataatctaagcatgagataaccgtggcctggaccagggtagtggaggtctagatggtgagccatggtcagatgctggatgtacattgaaggcttattgtggccacaggtgggataaaacccttaatctcaaggctacgcttgctctgttatgggaaattgcatttatatattacatgttgtaattacagaactatgtttgcagtaggaaaataagtgtagttgcccaaagcagtaacgtacagccatcacgcgccaccctgctgactctttttctgtaacttcatttgtatctgagtggcttcacttcacttgttattcagaaagcctcgataccctttgtgttgacgtttggttacaggtatgtaacctgtttgtaatcaactttgtgacactaagagatttatttctaaacagcaacataaattcaaaattttccctaagtgccaaatctatcatttgcagacatgtatgggtggaactgagattcactaacatttactgggcgtttaatacatgccaagtactacattggggcactcacagaactgttatgaattgatctttccaataacttcaaaagaagtaaatttaagtgtacatattaaaatttccaagtttccaaatataggccaagattccaaaagtctttcctttgctctgcaatatatacttactcagtgacatcacgtcatctgctgttagtgagcactggtgaagatctaggacttgtagatgctttagcatgaccaactgagccggcgagtcttcaaaacctccacctagatccttattgcaggaaagatctaatttcctcagctcacccaaatacctaaaagcagcatctacaaagaaagtcagaatcccattctggtagctggacacagtggtgtacctatagtcccagctgctagggagaccaaggcaggaggattgcttgagccccggagttcgagtccagcttgggcagcatagtgagatccatctcttaaaaaaagaaaaaccgggctgggcgtgatgactcccatctgtaatcctaggactttgggaggctgagagggtggatcacagggtcaggagttcaagaccagcctggccaagatggtgaaaccccatctctgctaccattctgacatatcgcaaggtggtaagaaggtgtggaacaggggtggggccatggtgcagtaagggaggttgagggaacacactgtgttcacaaaagacaaaaggaggaataagtgtagacttcctaccatctggccttctgtgaacccgaccatgatttcacacacacgcttcctaagatctgcatacattgccaagggttttgacatgaatcctgcaactacacttgagcatcctctcctattacacttgagcattggagtttacatagatttttagacttattcaagctgccagtgaatattacaggttctgtaagttgaaggggaaacacaatatcatttcctattctctgttaatatggatactatatacagaggagtaagttttaactgtggacgccatcgaagccgttctttttatcagtacctattccttcctactactgagcataaaataatgctgacactttcaaaagagaaaacctagtagttctagcagcaaagaaactttatttttcccagtgtttatcttaacctaaaatatactggccttttcagagtcagtcatactaaaggcttatttttataatcatgaaagtgtatgttctctataaaatatttagaaaataaataaaatataaaatatgtatatatttttgagatggagtctcttctgtcacccacatcggctcgctgcaacctcacctcctgagttcaagcaatttctcctgcctcagcctcccaagtagctgggattacaggcgcacgtaccaccacgcccaactaatttttgtatttttagtagagatggggtttcaccatgttggccaggctggtctcaaactcctgatctcaagtgatccgcctgcctcagcctcccaaagtgctgggattgcagatgtaagccactgtgcccagcctaaaggagatttcaattacccataatcttattccccagcacaaccactgtttatattttgctatatttcctagtaacttttcaatatatatatttatatgtatatcatatataattatacatgtaatcttaaatccagccattgttaactcacccaatattttgacactcttttgtgataatccacatgaatgtaacttcagtactttcagatttgaggtgctttttaatccctgagcaatactgttcagactgccaacaatgtctctgttaatggaaagatcaagtacttcgagactttgcagcataggtagcagttgacctagaaggaaagaaatccaaataagaagggtaggtaggaggggagtggagttttacatcacctggggatatcgtgacgtaaaactccactcccctcctacatacccttctttaaattcagaataagacaaaacacagcaaacttcccaagctatccagtgggcatcttcactttttttttttctcttcaaattccacttacccagaaatgtcccatcttctgacgtgagggagcaatccacaagctcaatcatttgtatcttgctccctttttggaacttctgaaggatcagaggcaaatttcctcccactttactgttccaagacaaatttagctcttcaagttcaggaatcatctcaaatgcttctcctgttaacaaatggcccgaaaattctgttggtcactagtcagaaaagcagggaattcatttcagaatcagcacaaccatgattaatggagtgtggaaactgggccaggtactgtcctgtttggcaccgaggaacagagagaaggaaagaacccaattccttcatagcagggcgtgcttctctagatttacaggcacagtcattctaatccctccaaaattctgaagccatgcgtatgagctaaacaattgttgttgtagaaaaatccacctattggtagggtggttttaggaagctgcttttgtggtggttcatctgctttcccttagcccctctctctgggatcagcatttctgagaagtttgaccagggatagaagtgaggcaaagcagataactggccaccacagaggtaaagctctctccaatgtcaagaatatcacatgcctatatatatatatatatatatatatatacacacacacacacacacacacacaagtatatatatacacatatatacatacacacacatatacatatacatatatatatatatgaggaatatcacatgcaacctgaactgaccactacagagagaaactaataatagagcatcaggcactagaagcttataacagccgtgctgccttaaggggtaaaggagggtgcagtgacacagggatgaaaactaacatttctgaaaccattacacactggaaagctcccagggctgcagagtggaggctgggagagaataggagaagtgaccaaacagatctgtccttaggaatgattttcactgccttgcgggtagacacatacatggaaaatgtactttctcaatgtgcaaacaattaagcattctggcaagtcccctgtatctagaaccctctttactacctgtccctgggtttgaacttctaccatggtttattcattccatggattaaggttttagaagtccaggaaccccatgctaaaatgcgtattccccaggagttatagcatcttaagccagcaatgaacaggcatcattttttgtgctattaccagtcaattgggggtgactttctatagccctgaggtgttccccaggctcagggagaaagagctcatgattgattagttatgtctgcagtggtcatggtactggagtgccatgcatttgccactcggtactaaactattataatgggtgtaacaattttgaaatgccttctgatttatgttctcttatcaagaaaccatttattttccctataccccatctgcattaaggttgagtgaagaagatagagtatgggtgataggtaagcccctcctgatgggagaggatgcagaagtccttccagagaagaaataactctgggagagggaaaagggcgcaaacatcagaacaacaacagtgcagactccctcctcaaccaggtaagtttggaacaggtcccagggcagaaatttcattttcttgttttctaaggatggagggtcaggaaaaagatcaggttaatcacagaaaataagaaagttgtcttttcacacctgagtaatggtatgttaaaattgtgagtctgctacatgataaccagctgcttaatgtggggctaaactcatcatgtaaacccacagaaaggtggttttagatgacagaatggagaaagaaggactatcagttattgagcaactattatgcaccaggcatgcagtaggcactttacagaaattgtttaatccttgcaacaattttttgagagggaggttatccctatttcagatataagaaaaccgaggctcagaaatttaaattatttgttcatgttcacaaagctagttaaaagtggcactagaggctgggcatggtggctcacgcctgtaatcctagcactttgggaggccaaggcgggcagatcacttgaagtcaggagttcaaaaccagcctggccagcatggtgaaaccctatctctactaaaaatacaaaaaaattagccaggcatggtggtacatgcctgtaatcccagctacttgggaggctgaggcaggagaatcacttgaactcaggaggcggaggtttcagtgagccaagattgcaccactgcactccagcctgggtgacaagaatgaaacgccatctcaaaaaaaaaaagggggggggtgggggatgggcactaggatttgaagtaggatctactaaaaataaaaaaaatacaaaataattacaaaaattagccaggcatggtggtgcacgcctaaaatacaaaaaaatacaaaaaattagccgggcatggtggtgcactcctgtaatcccagctacttgggaggctgaggcaggagaatcacttgaacctgggaggcagaggtttcagtgagccaagattgcaccactgcactccagcctgggtgacaagaatgaaacaccgtctcaaaaaaaaaaaggccgggggggcgggtaggcactaggatttgaagtaggatctggccaacctgagatgtgtaatgtttctcctcagctacaggaggcatgggccgggggacgtcagctgcccccatttccagggagagactgacaagcggagatatttggcataaaatgtgttgtttttacagaaatctttaaatagctgtaaaggattaaaataagtcatgaaaataagaaactttacatcaaaagaagaataaaaagtatcaaagacatctaataaaccagcaagcattttagtacagcagttggataagtagaatgactgtgtacaaatttaatcctatgaaactaacttaatggaggttctagttctagttaaactattaacttaaaaatcttgttttgtttaatgtttcaaaatgtgggtgggaaaatagaagagagaagtattcttttggaattgtaaaagaacttaattcttgtctactctaactcctctattttacacatgaagtaacagacccagtgtaagcatgttttacagtaacctccattgaaactacatgaggctggacacggtggctcacacctataatctcaacactttgggaggccaaggtgagtggattccctgaggtcagacgttcgagaccagcctggccaacatggtgaaacccccatctctactaaaaatacaaaaattaaccaggtgtgatggttcacacctgtaatcccagctacttggaaggctgaggcaggagaattgcttgaacctgggaggcagaggttgcagtgagccgagactgcaccactgcactccagcctgggcaacagagtgagcctccatctcaaaaaaataaaaataaaaataaataaataaataaactccatgaaagcagggacctggtcagccttgttcttttttttcttttcttttctttttttttgtttggagatggagtctcactctgtcacctaggctggtgtgcagtggcacgatctcggctcactgcaacttccgcctcccaggttcaagcgatcctcctgcctcagcttcctgagtagctgggactacaggagcccaccaccacacccggctaactttttgtattttagtagagacagggtttcaccatgttgcccaggctgttctcgaactcctgagctcaggcaatccgccagcctcagcctcccaaagtgttaggattacagctgtgagccacggcgcccggccgaatccatcttttaagaaatgcattcatcatacccagtgcttgaacatcgtcagtggtgagtctgcagctacccagcctcaagatttttaacttgctgaccagatgcatttgctgagtgatggaaaggagggttccacctacaaaaccattccaggagatatccagttcttccaagtctgggagaaaaggcagcaaggcaactagaagtgaacagaagaaaatacagatatgtgtatgtgacttgtgatttgtagtaaataaaatgcaatgcttacatacacaggatatagttttacactgtaagagaatagacagtggtaggcacgctgactttgggcaaagcagggagccctcagctgtacaagtggagaaattgtgatgtttacatttgctatttcttgggatgttttctatttctgccaaataactgcagtctgaaaatgcaggagtgtgtctgtaagatttcatacagcctcttttcctaaactcagctgaagtcttcaaaacttgaggaaggatcaattaacttgtttttcttttccttttttttttttttttttcagacggagtctcgatctgtcgccaggctggagtgcagtggcacgatcttggctcactgcaacctccgcctcccaggttcaagtaattctctgcctcagcctcccgagtggctgggattacaggcacccgccaccacgcctggctaacttttgtatttttagtagagacggggtttcaccatcttggccaggctcgtcttcaactcctaaccccgtgattcacccgcctcggcctcccaaagtgctgggattacaggcgtgagccactgcgcctggcctttttcttaaaaaaaaaagaaaaaagaaaaaagaaaaaacctactcgggaggctgaggcaggagaatggcgtgaacccgggaggcggagcttacagtgagctgagatgcgtcactgcactccagcctgggtgacagagcgagactccgtctcaaaaaaaaaaaaaaagcgatgctgtttctgcaattgtctgggaccactcagcagacttggggttactaggtgggtagctgagtatgttttatctgcttatctcaatggaaaggccctatcttcctctatgcaaagtctgctgcatacagacccatttctttcatgtccgctgttgttaatccacagttattcaaatctagacacttgttgacagcctttttgcccagcttctgcaggaaatgctcatttttctccatactggatctccattccatttctgaactgagaggcttagctgtgtgataagcataaaaaagaatttgctgttaatgatggatgtattaaagatgcataatgaccacaatcagacaagtgaaaagactgcataactctgaattgctcttttataaaaacctcaactcagaggcagagccatttactagggacaaagcttaactaaccactgttcctgccgccaggtgcccagacactgcttcaggagcctgaggaacgcagtggcttttctatcatgacctgacctgggcttctcagcatgaagacagagctgcattcctgggtgagaagtaaacctgtcagcccggcttttgagatgcttgcttacttgaagggcacgcatatctttggtggatgcaactgctagggaggaagcagagatacttgcctcctcaaaccaaacaggtgaagaagggaaagcgttgaaatcaccatcaaggagctgcaaatggccacacggagtaagtggaattcttgccggtcagtttctagaccattcaattggcaaacacaaatccagagaaactaggcctgggagagcttttgctttttctcaactcctgccagaaagtgaatttggaaagcctcgtctgtcctccttgttattagggactactgtggcaccctcactagcttcctctgtaataacactgtaataacatgctagtggctgggcacggtgcctcacacctgtaatcctagtactttggaaggctgaggcgggtggatcatgaggtcaggagatcaacaccatcctggccaacatggtgaaatgctgtctctactaaaatacaaaaaattagccgggcgtggtggtgcacacctgtagtcccagctactcaggaggctgaggcaggggaatatcttgaacccaggaggcagagattgcagtaagctgagattgtgccacttcacaccagcctggcaacagagagaaactgcatctaaaaaaaataaataaataaataaaaaagatagcactataataataaaagctatcattttattgagcacctgttatgtactcgttctttgcctacttgcaggtgccagcatttcttttttctttctttttttttttgttgggggggatggagtctcactctgtcacccaggttagagtgcagtggcacagtctcagctcactgcaacctccacctcccaggttcaagcaattctcctgcctcagcctcccgagtagctgggactacaagcgcctgccaccacgcccggctaatttttgtatttttagtagagatgaggggttcgccatgttggccaggctggtctcgaactcctgacctcaggtgatccacctacccggcctcccaaagtgctgggattacaggcatgagtcaccatggcaggccaggtgccagcatttaagacatacataaaacacatcatacttttctaaggaaaaatgaatatacatgtactgacagtgattttaaagtgattttgtaagtgaaatatacaattttaaacatatagattatgtatattgaaatccaataggaaataataagttctggaatgagcagtaatattttattaaccctgacaaaaaggtgtaagacaacatagctaagaagaaatacattggtacctgtgaaaattaaaagatagtaggtttgcagtagtaataaatttagaccaaatgattagcaggataataaaaactacacctgtaatccacagcagtcttgtggcttcctgtttggtctaagaaaaccacacgtaggatacgcgtccttgttgggatgcttggtgttaccacatttcaccagtaggaggcagcagcatccaccatttaacctttcactctcgccttccgtttttatggcacattggacacaaggcatttaattttgggtagagttgccagatttaggaaaaacaacaacagggtgcccagttaaatttaaattttaaatcgacaaggaattcttttattgtatgcctcaactgttgcatgtattttctctggcaaccctaattttgggtggggcagagcagaattgtggatgggagacagggagggactgcctcttaggtgccagcaagtacaggacattttgtctaaacgagtcacaaaccatttcatagatttggaaacttagagacacgattaattaggaagaagcagagcctgaatttgaacccagaatagtttgttccaaagcctagtgtgtgtgtgtgtgtgtgtgtgtgtgttatttttgtattttaaaaaatttctctgcattgcatcttattgctgtctctcttttgtttttaagctttttatctcgacctacaatcatcctcaagttccagccccaccaaacccactcttctgttttctcctcaagacactgctctgtcaagcatttcctttactgtcaaatgtttggaaagagtggtttccacttgctggcccaactccttccccacatttacaagctaaccctctaccttctggttgctacactcctctatccaaatacattgtttctcaaaggtcaccaacaataacctacaaactgacagacgcagaaatctcttctcagtccacatcccactgggtgctctgtcatgtttgatgtgactgacaagtaagcagtacagtcaaaagacctgatccaaatcacaggtctgtctgaggaacaagtcactcaacctctctgagccttggtttactcatctatgaaatgcctggttcatttctcaagagcatcgtgatttaaacttactggaacctcctatgcacatggtaatctgcagggccttttacctgagaggtatttggtaaatatttgttaaatgagcaaacaattgaatgaatgaatattggttttacagttcctcaattaccaaaataaatcatcatgataaatctttatcaaaacacttaaatataaatgtgagtactaacttatgagacccctggacatctcctcacagatcatgtatttcaatttttaaaaaatctgtgaaaccggccaggtgcagtggctcatgcctgtgatcccagcacttaggaaggctgaggcaggtggatcacctgaggtcaggagttcaaaaccaggctggccaacatggcaaaacaccgtctctattaaaaatacaaaaatttgccaggcgtactggcatgcacctgtaatcccagctacttgggaggctgaggcaggagaattgcttgaacccagaaggcagaggttgcgtgagccgagattgtcccactgcactccagcctgggcaacagagcaagactccatctcaaaaaaaaaaaaacctatgaaaccaaattagcccagtgtagtggcgggtgcctgtagtcccagctagtagggggctgaggcacaagaatctcttgaacccgggaggtggagttgcagtgagccgagattgcgccactgtagtccagcctgggcgacagagtaaggctctatctcaaaaaaaaaaaaaagaaaaattatatgaagccttctcttcacaggataccttatgtcacagctcagtgtgtagaacaagtgagtcagggctgctacagctaggctggagtggggtgggaggcacccatggggggcgcattagtaaccacacaggagccgctctgtggagattgaggccttttcctagctgtgttagctctgaacaaagctctcggttcttagtgctctcactaagttcctttccgactgaaatctgtcaaggtttgtcaaccaaaactctcgacactcataaaacattattacacattggtaacatgggtggtactgtaccaggaaccaacataacaagttcctgttttcaaagagctgcctgtttaatgaaagagacagcaagaaagccaccgttaccgtatagatgagaagtggaggcacgcaggggtgtgtggttccacacttcagtgacaataagtacctcaagtctggtgattccaggtcggggaggagggtcttgggaagtttccaagagaaactggtgcctggattgcaccttaaaggaagagtgggagtcatccaggtgggtggacatgagggagggataagtcggggggttgcaggggaggatggtgacacgagggaacatctttctagccacaaagaaccacttgctggggatgggagaagaatgtggccagtccagggaattataagtaaatcagagggccacacgtagaggatgagggcggcgctgtggtgggaggtgggagaaggcaaaggtcatgaagagatatccaatatccaactgatcactaataccttgagggccatgcttgggaatataggtgagagaaactcagtgaaggattttaagcaggcgagagacaccaccatatctgtggtttagaaagagcattatggcagtgtagaggacagattggcaagagagcaagactggaagcagagaaaccagttaggaagctattgctgtggtccaggcaagagacaatgagagctaggcagcagcaatggagaggaagaaccaggtgggagagctatttaaggacagaattaacatgactccaggagccatagaattttgggagaaatagaaatgaagaaccaagcagcttgggtggtcagtgttgcacagcagggatgaccccggcttggttttgcactgttaatttaatcacaattacatttattcattatcttctttcctgatgctctaaatcacactctagaacaaaaatgaacaattttctgatagagatggttttcttttaaagacagactttaatttcctatttataaaaacatacttaaaatacatttaatctacttgctgctaaaactgtattatttttggcatttgatggcaaacaatctgatggaagggagggtaggtataaatgatataaaattggctaggcacagtggctcctggccaggcctgtaatcccagtactttgggaggccaaggcaggcagatcacctaaggtcaggacttcgagatcagcctggcccacaaggtgaaattccttctctactaaaaatacaaaaaaattagctgggcatggtggcggacacctgtagttccagctacttgggaggctgagacaagagaatcacttgaacctgggaggcagaggttgcagtgagccgagatcacactgctgcactccagactgggtgacggtgcgaaactctgtctcaaaaagaaagaaagaaacaaaatcggccatgggttgattttttttttttctgtctcagaaagaaaattggccatgggttttttttgtttgtttgtttgtttttttttttttgagggtcttgctctgtcactcagcctggagtccagtggtgcaatcatggcttaccacagcttcaacctctaaaattcaagcgatcctcccacctcagcctccagagtagctaggaccacaggcatgcaccaccatgcccagctaatttttaaactattttctagagatggagtctttttttttttttttttttttgagacagagtcttgctctgtcgcccagactggagtgcagtggcgcagtggtgcaatcttggctcactgaaacctccacctcccggattcaagcgattctcctgcctcagcctcccgagtagctgggattacaggcacctgctaccacacccggctacttttttatatttttaatagagactgggttttaccgtattagccaggatggtctcgatctcctgacctcatgatatgcctgcctcggcctcccaaagtgttgggattacaggcatgagccaccgcacccgaccaagacagagtcttgctatattgcccaggctggtcttaaactactggccttaagcgatcctcctgcctcagcttgccaaagtgctgggattacaggcatgaaacaccatgcccaactgataattactaaaagtaggtgactatggggattctttattctatttttgcatatgcttaaaatgtttttaaaatgcttttaatctaatagataatatattgatgacattgcacataacacataactttagagagagatttgacaatatttattttcataacccttgaatttgcaatccctgttctggaaatttatactttaaaaatagctgaaatatggtgaaacagggaatgggaaagaaagaaagccaaagatactcaccgaaggacaaacaaggaactcactgagtaattaagacatatgaatgtgatggaatattatgcaaccatgaaaattatgcatatgagcatcatgtagcaatgtgggaattgagcaatataataatatgttctagaagtaggatcacagctccacataaactcaggaggaatctgtaagctattacaactgtggaaaagatgccaatctggccccagcgacctctctgacttgtcttccactaccccttcctctccatgtctcccatcctgctttagcatccctgacttcctgactctctctcaagcactctaggctcagtcgtatctaaagcctttgcatgtacagtctctttgcctggaaagctatttgcacaaatacctaagtggctcgctttattcattcattcagcaaagctgattttattcagattgctgctcaaatgcctccaaatcgaagacttctttcctccacccccatctaaatagcaccccatcccatcattctttgtctccttagcctgcattatttttcttcatatcacttatcaccacctgaagttatatctgcatttggtccttttcatggctgtatttctaacacttagagcaggggttactacatagcaagcactcaataaagatttattgactgctgactgacagaacataaatgcatgcatatgaaaagaaaagactgaaaagaatcttaaagaaatgatcgtttgtgttataatgaaaggaaattcagtattttccctacatttttctgtagtgttatattgcttttaacaatttaaaagtaaaattatgaatcatttaaagcatgtaagtaacataataaatgattagcacagagactcatagttgagtctttagtctcaaaagtcttaaagtctttagtttaacccataagatcactttagaagaaaactctaaaaaataaagaaacatagaggctgggaagggtgtgtgtgttgttggtgggggaggtgtggatggttaatgggtacagaaaaaatagaatatataagatctactgtttgatagcacaacagggtgactatatttatcctttgtttacaaacaacccgttgtgctcttttagttatttttaaatgtgcaataatttattgcacatttaaaaataactaaaagaggcctggtgtgatggcttacacctgtaatcccagcagtttgggaggccaaggcaggaaaatcacctgaggtcaggaattcgagaccaccctggccaatgcagtgaaaccccatctctactaaaaacacaaaaattagctgggcatggtggtgcgcatctgtaatcccagctactcgggaggctgaggcaggagaatcgcttgaacccgggaggcagaggttactatgagctgagatcacgccattgcactccagcctgggtgacaagagtgaaactctgtctcaaaataaataaataaataaataaaactaaaggtataatgggattgtttgtaacacaaaggataaatgcttgaggggatggataccccattctccacaatatgattattaggcattgcatgcctgtattgaaacatctcatataccccataaatatatacacctactatgtacccacaaaaattaaaaataaaaatattttaaatgtggaagtaaaaacaaaacaaatacaacagcaaaaacaccagcagccagcagcttaccagtctctgaggtggctgtcttctgtatccagtcgctgggttgggaatcacttgttttaaggtcattgtcctcttttctgctttcagcattggagcccctgagaaatttgttgacagttgaagtctggggcttagtttctccttctgaggaagttttcttccttgtttgactcatggtgaagttgatgggggtagttcccaataagacatcttcctgttgctttctgttttctaggatttctaagaagaaaagaagattctgtcaagcctgtgttcaatcaaaatatcctcccctacatgactgccccccactccctgccgcaccacctttctttttctgtttttttattgctgttaatgtttaacatgaaaataagaatgatgtaacccaggatccagaagccaatacaaactcaaagcaatttgagtttttaactttgccctatttcattgtgtgagatacaagtcattaagcatgactttggcaagcacatcaagtgtgtcaacacatcttaaattacagctgtcaattagttacctgaagacttaatatgcctttaaaagggactggccatttgcaaagctgtccccagaggagtttgccttcagcgacctctgccttctggtgacccccacctccttcctttgcacataagctcctttttctctttgcatattcatattttctctacccccaaccctgcaccaccaccccactgaaacatgttggcagtaaagaattcattcattccataaatagttttaaagaatctactgtgggccagttaatgttctaaatgcaaaagattcaatgacgaacaagagacagttcttgtctttgatgggatcttaacctggtgggaagatggacctgtatgccattgattgagtgggacaagagccaagagatgggaggtggtcagggaacccacagtaaactaagcatgccttggagaacagacttggaacagtgagtgacattgcctgggttttgaaggactgcgagttagctttttaagagagggaagagtatcccaggcagaagaaagggtaagctcaagagctcccaggcaggaacggctggaagagcctagcattggaggtggggatgtgggtcagggggtgtggaggttaggggtgaggtctggtatgaattgaagctaaaaaggattcgtaaaggtcaatctattatctctcctgaaatttgcttatattttatgggagggctaaggacttaaactaaagggatacacagaagtgttttgttttgttttgacatagagatggattttcaccatgttggccaggctcgtcttgaatttctggcctcaagtgatccgcccacctcgacctcccaaagtgctgggcttaaaggtgtgaaccatcatgcccagcagaagtattcttgaaattacagttttcatagtctcctctctaataaaatagctctttctgtaacattatgttccagaatggtccaagaaacattttacacagggaatcctaaaaatggaccttgcagagcccacctccactcgtgagggctggaatgttccatgcacttggagcactgctttggaagtcacaattggacattccatttttcttttaaaatcttcctttcatattagagcagggcccagccctggtttacccagcaacagacagcagtggaactaaacaattactccatgcacagcagcacagctgactagagtctcagggggttaggtggaaaagaagaaggaaaggggcgctaactcataaatctaaacatgacctgcagccctggctgcctcaccctgattccaccatcaccccaggcctttctcaatttgctactcttctggccccccacccaggacacctccatggtcattttcagccaatttcaccatttggagatttagacagggctattctctggggagctagctcagtaaatggtttcacttttttatcctccccccaaatgcactgactccaactccccaagtcctaagaaaacagtgctggagggtgctccaggatgtggtaatttacccaggtgaaaccacacccagcttctgaggcccagccagttctctgtgaagatcagtacactaaggaacaggggagccaggaagccaagaaacacaagaaccaaggaacagaagaggatgtgaaggagaggaaaggaacaggagaatagaaagcaaccaggaggctaataaggcaacaagaaaggaccatgccagaggaaggaaggcttttgaatgaaaagggggaagcatttgcacatttcttcatgtatagtagttaagtgctaggttaccatactcatatttaaaaataataataattttttcttgaaaatatgtctgggaaattcctctttatataaaaactttaataagccctcaggcttcccaaaccaagtccatctttaaaatcttagcttcagtaaaccttccgcttcctccttatccctgaactggactttataaaggaaatccctggaaaaggaatttgggaaaatttgcagatcacagcacaaccaccacaatacagcagctaaaaactgggggtttgtcccttctaccagggtcaaaagcattcacttaagagcccttaggaataagaaatggctgatatttcaattcaactcatcaatattaattgagcagatactttccatatttactatattcttaatagttaaggttttgccatgaagcctcaagagtaataatacatatttgacacgtcatttctcttgcatgtaagctctttttatttattacttttgcaaaagtaaggaatacctttcctttcttgtcaatccttaggtttgggtttaatataatttaaaatttttgaggaatgtctttaaaggtctttctttctttattcttttttttttttttttttggagatggagtctcactgttgcccaggctgaaattcagtgccgcaatcttggctcactgcaacctctgcctcctgggttcaagtgattctcctgcctcaacctcccaaatagctgggattacaagcatccgccaccacacgtggctaatttttgtatgtttagtagagacggggtttcaccatgttgactaggctggtctcaaactcctgacctcaggtggtgcgcccacctcggcctcccatagtgctgagattacaggcgtgagccaccgcacctagccagtctttcattttttgatgtaatgtttcagagtgaatcatattttcaatgttgtttgtcaaagggagatgcatttttctttctccacagtcttatttcattaaaaaaagaaaggaaattctgttgcctgttacaacatgaatgaatcttgaggacattaggccaagtgaaataagccagtcacaataagataaatactgtatgacacctcttctatgcagtatctaaagtagccaaattcatggaaacagtaaaaattgtgtttgccaggggctagggggaggggaagtagggagtcgtctgatgggtataaagttccagttttgcaagatgaaaaagttcgtctttgtacaactttgtgaatctgttgtacaacaatgtgaatatatttaacactactgaactgtatacttaaaaatggtcaagatggttaattttgtgttctgtagtttttaccacaattaaaacatttttaagtgtatttttaaaaagtgattcaggctgggtgcagtgtctcacacctgtaattccagcactttggggaggccaaggcaggcagatttcctgagctcaggagttcaagaccaccctgggcaacatgatgaaaccccatctctactaaaatacaaaaaattagccgggtgtggcagtgtgcacctgtagtcccagctattcgtgagactgaggcacgagaatcgcttgagcccaggaggcagaggttgcagtgagccaagattgcaccactgcactccagcttgggctacagagtgagactccatctcaaaaaaaaatagaaagtgattcagaggactgaactccaaatgtaaagttttaagaatacagtaatcaatttctacttttattttccttcttatgtatccacaaatgtgacatgattttagaaaatccatgcctaactactaaatagatttttaataagcataaaataaaaatcctaggtaatcggaaaaaaaaaagcttcagtcactcagttctaaggcattgtggtggcacgcagtatcttgagttctatgtctgatgagcttagttcagccttattcagaactcttgtcttaaagaggcattattgtagatatatttgtagtactttagttcactgtactatttttagttaatttaagcagaaaaggaatttattaaaagaatgatatggaagttctactaaaacgatggcagaggtaaatatgtgtttacctccacttctcttgaaaccctatttaatcaacagatttttaaaaaaatcataaatctgtaaggataaggagaactggatagatgttaacacaactttgaaaactagagagcaagaggatgagtttaactgactttaaagttaagtgtctgcatggattgggagaacaaatttttcaaacgtcagaatcccgaaagtctcagtaattgacagcacaaggtaactctgaaggaaagagatgtgtgggtagagctgcacacaagatgattcgcgaaacatttgtaagaggttaaattgttaaattctatttctcacttcgggcagccaggaggctaccccttccccatcttggcagaagaatgtttattttcacgacacgtcgaaacatagaagatccagactcagacactggtcaagttttgaataccttatctgaaaggagcttaagtaaagtctataactgagctatgaaacccgtccctattccctcttctgttcctccaagaacaccctgacaaccaaatgtaactacccacttcgccacataacagaggtggagtggatgacaactatctgaagaaactggccagcctaagagaaaaaacctagatattgactgttgaaagtccttcagctaaatgaatctgtccctgcccaagcacgttacaaagaaacccactgactgacaggccctacttttgtacacagacattccagtataatgcataatctacatatgcgtggagcaccaaggatgtcaagatatttgaggaaagattctgacataacaccaaggtgcagaaacagtaagaaaaatgaaacttggaaaataaagacaatgtggggagaagaagggacttttacaaatcactattatacttagagtgttaagagatgagacgatgtatggttcataagtcaagagaaaatccagagaacagaagaacttctagatagcagtttctgggcaagatgaaaatgttgatggtgaagtggggttttttgtttgtttgtttgtttgtttgtttgtttgtttttatgtatttattgagatggactctagctctgtcgcccaggctggagtgcagtggtgcgatcctggctcactgcaacctctgcctcctgggttcaagcaattctcctgcctcagcctcccaagtagctggggttacaggtgctcaccaccacacccagctaatttttgtatttttagtagagatggggtttcaccacgttggccaggctggtcttgaactcctgacctcaagtgatccgcccaccttggcctcccaaagtgctggaattacaggcatgagccaccacacccagctgttgttgcagtttggagtctacccagtcctccaacaataacccctctgaggcccatgaaagccctgggctcagccagagttgagcagatgagggaacaaccagctgcagagaggagccaccttctctgctgagaacttcagagatctgcagagaccaccaaatgaccaaatgacctgcctgcagggaggaactaccctctccaagggcctcctctctgctgagcactgaacactgagggtatgacctgcctgcctacagaggggagctacccactgtgggtctcctctgagctgttctaacactaaataaagctcctcttcatcttcttcaccatccacttgtctgtgtacctcattcttcctggacacaggacaagaactcaggcaaaggtgctaccagccacagggttttcaggaagaaaatagacacccaaagatccagtaacaatattattcaggcacaaaaatataatgaagtattgatacataactgaatatgaataaatcttgaaaatatgctaagtgaaagaagtcaaacataaaaggccacatatattattccgtttatattaaatagccagaataaaacaaagtagattaatagttgtacattgggtgaggagatagggatattataactaaaggatatagagtttcatttccacatttctacagaaatgtggaattgtcctaaaattgattgtggtgatgattgcacaactgtgaatatatttaaagtcattgaattgtacacattaaatgagtgaacttacacatttttggtatattttgtggttaagctgtgaacaacttttacattgccataatagtataaacactatatgttaaaactcaggaataaccatattggaatgccgaggaaaggggaaatttgcaaacatgtaacagaaataaatcctcatttgtcctacaaagaggacaataggtaatacctaaaaatgaaataacagtataagcatgttatttggaaatgcagaggtacacagcacacaaaaggtaaaagggatgcatttcctgaacaaaactcttacttattatatttagagttttctgaatctgacagaaacaatttaaattaattttttttcttattaagtcttttgggaaagagagatgagaaatcacagtgacaatctcaaagaactaaaagctgttctggctttttacaaccttctggagaaaaatgaaaatatagaaaatatatactagtgatgtcatttacaacttaagtaaaggataacaggcattttgtgaactaacaatttcctcaaaaaaaaaatcctaaattcaagcaaattatttcaagtctagaaattataaattacattgaagttgcttaaatacattaaaagcatttaggcaagctgaaagttttctcttaatatgaactagagcaagcaaacagttacctagcactcccagaaagtcacttcaactcaggcctttcatagcacatcatctttatggatgttttgtcttagttatttctttttaatcaaagctgggcaaaaggagacaaataattttaatctctattttctccttgttaccgctgagtgcagacaccacgttctgcaccattgaccccattgatgcggcaggctaggctctctgctagaaccttggcccctactgccttcgaagcctaatataattgccacagccaaggccatgtcttcagaatggattctgcatgattcatgcttcctggtgccataagtgcagcttctaagcctccccagagattctttgaaatacctgtggaattaaaaacaaaatacagtctgggtgcagtggctcacacctgtaatcccagcactttgggaggctgaggcgagtggatcacttgaggtcaggagttcgaaaccagcctggccaacatggcaaaaccctgtctctactaaaaatacaaaaattagctgggcatggtggtacccacctgtaatccagctactcaggaggctgaggcaggagaattgcttaaaccggggaggcatgaacctgggaagcagaggttacagtgagccaagattgcgccactgcactccaccctggcgacagagcaagactccgtctcaaaaaaaaaaaaaagaaaaaaaagttttaaaatgcattttgaatttaagctgcctggttacattatgacctggggaaagcctgaggtcagaactgacatgacctgagaaagacaaagggaagggaaggccactgttgggtgaagtgctgtgctctcagcatttctcccctgctgctctatggcatcctccacccagctgttgatggtaggtgccctcgctccactatctgtgttgtgctctttttcctccctgatcttctcccaggctctccctggagaagcccaggctcaggagggccatccagcctccaaaacccgagtcctaccacccccaagccagctcacctcccacatccccatagactttgactatgtaactggctgtgtggagctttctcacctctgaaattcttgtattgcctgacctgtatttaaaaatacatagccatgaatttaagtaataagtaatttaaggtattaacatcttgcttcctcagctgggcagttagttccttaaggacaacagccatgagttgtatttctttgcacctattaatacccggtaacggcattataggtcacagatgttcataaatgtgtgactgatgctgaggcaggcccattctgcaaagctccaagagcaactgtatttcaaggcaaatgagggagagcaacagcaaaccatccatggttcacatgtaacaaagggactaaatctgcttgtcctgtgaaggcaatgaatactcaaagagcctgcccgggtaagcagattctgttattgacctaaagttcattgtcacaggggcatttctggtaaagccctgagcttagggctgccaagataagaatgcacatttagccaggcgtggtggctcatgcctgtaatcccagcactttgggaggcccaggtgggcgggagttcgaaaccagcctgaccaatatggtgaaaccccatctttactaaaaatacaaaattagctgggtgtggtggcacatgcctataatcccagctactcgggaagctgaagcaggagaatcgcttgaacctgggaggcggaggttgcggtgagccgagatcacaccattgcactccagcctggcaacaagagcaaaactctgtctcaaaaaaaaaaaaaaaagaaaagaaaagaaaaaaagaaagcacattagccagtaaagaacatgacaatatgacaataagagtgaaatgggaaaaatattccttagagcaaagaatgcagtgcacttattttaggaggtaaaactcaagtcaccagttacagaacaatcaacccttcgtcctatcccaaccttaatgtttaggtcagtttcttgggtaggaggctgcgataaacattactattacacaccagtacctgccattctactcctctccctggattacctttttgaatttaggtggccttgtgacttgctttggccatcaaaatgttcgtgtaattgagatgcgacactcccaggcagaagcatttaacagccagtgctcaatttttccagccgtcttcccttgctgcagcaatcatgggagccaatgtccagtgagagatgcagcaaagtcggagcagggagacggagtgcattcactccaagtatacttactgagcaccaagtatgtacttactgagcaccaaccacgtacttagcaccaaccacgtacgaagcattgttaggcactgggaatctcctagtgcgcaaggcaaggtctctgccctcatggacgttcctgtctggcaggggagacatctatttttaacttatttttaacttagatataagtcattatttaattctggccgtgactcatgttatgaagaaagtagaacttgtccagagagcatagaatacaggcatcctgaggtctgagattcaatgggagggttgatttaagaacaaataggaggggccagttaaagaatattccaggctgaggttctgtgtcagggaggggtacagtgaatctgaaaaataaaaggccagtgtggctggacaagagaaagtggggcaacagttcatgagacttgtgaaacatgtagaagccagattgtgtggggcctgtgggctctgttaaagagttcagtctcttattccaaaactgactcgggtattcttgaaacaaacaatgaatggtcacttaccaccctcctgtcatattttcctatatcccagtagcccttgtggagtggcacagagctcttcccagttgggaaagagttaagcaagttgagaggttgagcacatacccctgccatgaggtcaccaaggggtctatcctattcctcctgtaggaaccagcaccttctaccatcccagtgatgctggctacagcagggaagcatggctgggactgcacaatccatggagctggtgggagccctgccctcctgagtggggctacagccacccaaactgtggttgtatatccgagcctccctgtgctcttggagggggctaggagtaggcagggtctgcctgcctggttgccacagcaactgccagacctgcagctgcagagctgggcctcctgctccacagagcaggcaggagccagggacaagcaggaaccccaccccttctgagttggcaggaacagccaccctcccaggcacaggacctgggcatctttgcagcctgcaggctcagaggtgtctgctcccactgcctggtgcctctggtcccagaacctactctgatctcagagtggggttggggccataaatggcagtgggaagcagattgattcctgggcagaagggggcaggtccccagtaagtccccatgttcaggccagggagggcctgaaggctgggggcttgggctgccagtcctgtggactagagtggagactcgggatgcctcttccagacccacccatggctgcccatggaccaatcagcatgcacttcctcccctctgaggtctgtaaaagtcctaggctcagccagcagggcagaggatggccagagggtgaagaaggcagagagacagacgcaacaaccagctgcagaggagttaccctctctgctgagagctgcagagatgtcctgcctgccaagaggagccaccctctccagggcctcctctctgctgagagccgaacattcgacaggatgacctgcttacagagaggagctacccactgtgggtctccaacactaaataaaactcttcatcttcttcacccttcacttgtctgcatacctcattcttcctggatgcaggacaagcagtcaggccaagatgccaccagccacagaggtttctggcaaaaaaatcaatactccaaatatcccataacaccagggtattggcagcattctttggcagagacgaggaatcactctggatagcttaataaaagagaaatactgcctgtattaaatagctatggaatcatggagaaatggattctaagttgtgtttccaggaagtactcccaaagctaccccacataactgtgctacccagaaagctgtggccctctcatagtgaggacactgcctgttgaaactagaagtagtgtcacagttgctggctcaaaatcacagacatcaggaaattggatgtcacgtgacctgcctgtcaccctatgtacctcagttgcaaattcaaggcttgcacaaatgtgaaggatcaggagaacctcaatcacttcctgaacctagcttcaagggaggctgggaaaagtcattttaactttgtagtgtctgcagtagggaaaacctgctagaagagggttgaaattcagtatataatttattgtgttcatcacaccacatatcagaggaatcaaggttgacaagtgggatccccactttggaaagtcttctgactttcactttagctcttcaaaaccctatgctaacctagtgacactctccttatcttcctattgtatttttccctatcaaaaataaaaccactgtgaagcatgtatttctccacctcttttgcatttggttaaagcgtgtgcctttctgactttctattccttgctttgggaatattagaaactcttaaaagggtgagttcttcatcacagacgagctccgttggaacccagcactgtgtaatattcatacacatccttatacaaatattattggtctccctgagctcctgtataatgcagttgttctagactgttgtgggaaggtttaaaaggcagctaggtaatgcaataggaatgagcaatgttgaatcctgcttaaaggccagaggagggtagatagttcatacttctctgggctcgtatccttttctgtgaccacagttaaaaggtacagtacccttaaatctattatttcctctgcctttcctctaccttgggcagcatttgtgatgaggatgtatttagatagggctttgattttcaggattttgtgagtcctgatattttggcattgggcatatgggaggttacatccaggttaggaaaattttgtgagcatctaaatccatagagatgtggggttttttttggttttttttttggtttttttggtttttttgagacgaagccttgctctgttgccaggctgtagtgcagtggtgtgatctcggctcactgcaacctccaactccctggttaaagctattctcctgcctcagcctcccgagtagctgggattgcaccagctgcgccaccacacccagctagtttttgtatttttagtagagacagggtttcaccatgttagccaggatgctctcgatctcctgacctcgtgatccgcccgccttggcctccgaaagtgcagggattacaggcgtgagtgaccgcacccagccttatatggtggctttttaaactcaaatgaatgtgttctgtttgttacaatctgccaataaggagacaagttcaatggaggaggcaactgaggatgaacatctccgaaatgggagttgaatattgcataggccggctgcttactgtatcctctgtaataactcgctgagtaataaaggatgcatggctgcataaggaccacaggggactaactattaacggttgtggacatggccaggaaggaccgaaggtatggcatcagctgcacctaagattctgcacccaagactggtctttgccttctttattaccttgggacctcagagaggccttgaagtacaaaggggagagggccccatagcaaagagaaaccattattcctgccctgatagcggttatttctagaacttctcatgagcattcaaatagccctggtggagtgtggtggctcacacctgtaatcccagcactttgagagggcaaggcaggcagatcacttgaggtcaggagtttgagaccagcctggccaacacggggagacccctgtctctactaaaaatacaaaacaaaaattagcccggtgtggtggcacgtgcctgtaatcccagttactccggaggctgaggcaggggagttgcttgaaaccgggaagcagaggttgcagtgagccaagatcgcgccactgcattccaacctggatgacagagcaagattctgtctcaaaaaaaaaaaaaatagccctaatggttgagaatattagagcaaatgccagctgcctaattgttcttggggtggtgatgatgattatgatcatgatgatatcagaatccaacatgcattgagttctttgtatatgccagacaccataatgagcatctgacatacaccatctcatttaatcatcgcattatattattattattattccatgttatataagaagatattgaggcatacagcccatagatattgaggatcacacaaatagcaagttgttgcttgaggaaatccacgctcaaattcgccccataacacttactacttatcaatttttcctcttttgtggaaaacatatgagatttgaaaattataactcttgtctatgaaaattacatgagaagctatgtgtacctttcccagaaagataaattagtatattacaacaaattaaatgattgtgaaactcctgtgagaaatattccactgtagccttctccttaatagtgttagtaaagacctgagaaggagctaccaggtcactgaattggtcccagggtagattatggagtcaagaaagggtatcatttctgccagttgtttctgccccatggagaataattttaaaaggcagaatcatgctttgaagcggcacctggatatgaaaaaaacctttattccagtctccttaaagtggaggatttggaattccttggacacctgtagaagaggagatgtttctctgacaggggaatagaatcaatgtggataagtcctgagcatttttcagaactcatttagatagtatattagctggctcaggctgccgtaacaaaatactgcagactgggtgacttgagcaacaaatttattcatcacagttgtggagaacgtaagatcttggacacattctccacaattgtggagttaattaattgttagttaagtagtaagtgttataagggtgaatttgagcatggatttcctcaagcaacgacttgcgatttgtgtgatcaggactcatacaatcctgaaaatcgaaggcctatctgttgaccaaggtggggtttgtttcaggtaagacgtctctcctcagcttgcagcgactgccttctcgctgtatcttcacatggcctttcctctgtgtgcacacaacgcccagctaatttttgtatttttagtagagacagggtttcaccatgttggccaggatggtctccatctcttgacctcgtgatctgcctgcctcggcctccccaggtgctgggattacaggcgtgagccaccacacccaacctgtgagagctttttacgcatttcctcatggggcccccagagtaagtgaaccaccaccgcccattaggagtaaccaccttctaacacatatcctgggccagcttttcctctttctgtttcattcttccctgtccccaaataaactacaagtcttcaagcccaaattaagacatatctccccaaagaaaactgcttttctcttctttttcttttactttcttcattaaagcacttactcctttgtttcagggttaattattgatggaaaaaagtctaattctatttctatacctattagtcacacgtcttctgcactaaactaatgggatgaaattaactatgattgagtagaaacagaaggaattcaaaataactcctggagtgtgggaaaggagagattttgctctggcttttaatatgtcttattaaaaggccttctttccaaagtatccccagatactcatccagatccccatagcccaactgacgtttgatcattgtgtcctttctcgtggaactcatctttctctaccacattagaagttctttgaatgaaatgaccacctgcatacttgtaagtcttaagagttccctgttttacttaacacagtactgggcataaagcaaatgctcaataaaaatatgtttattaactggtaagcttgctcccaagggactgaaatcctagcactgcaccaactttccatagcaagttgctttttgtgatgaaaatacatgggactagatcagccaaggggaaaacctggcacattctgatcagcaaaggagaagtacacacacaaaaacctctttttaaaatgtttgatactttatatttgaaaaaaataacagaagcagtcatcacaggaaaggtaaattctttgctggactccctacaagtattttatagtttggaaccatttttacttgttttacataatagagggagcatggtgatctttccaacactggggcctctaagaacctcatccagttgagaaatcataataatgtaatttctttgtctcctttcttggatacattggtgatgctgagtgtttgtagaacaatcatttagaattccaaggtgttgtatacctgaagcagtagcagtaatgggtcagcgttacatgactgaagatctgttcagccttccttttaggtgaggatgactgtgataacataaaggggctttaggtttcagctttttgagaactaaacttttggaatagatctctaatatagatcctaaaatgtgtccatttttatttatttatttattattattattattattatttttagagacaggcagagtcttggtatgttgaggcagagtggtatctcactctgtctctaggctggacttgaactcctgggctcaagggatcctccaacctcagtctcctgaggagctgtgactactggcacatgccacagcccctggctcaaattttgtacttagtaaaaagtatttggcatcacaaaaacagggcttagatgctagcatagaaataacattggtagttgagatgatttcctatcatttcaagaggctgtcacccaaaagttgcaaagtgtccctgcctgggtccttccaatcaggggagaaacactactaattcacacagaacgttgtcaacaagatgctctgcttcccaggcctatttgcattcttatagggtcaacggtgcttgattcaaataaatgactacctgagggtaaaatttcagatgatgaaccatttagaattttctactttctcttaaagattatccactaagtttcctccagctcttaactttctgtaatacaattgcaaattcaaatgatgaaagtttgcatgtttaaacttagaaattgtcagaagagaaattttggttttattcaaatttgctttttaaacatttacaaaagagaagcagggaattgtcatcaccagttcgaaagcgaaatgccttctgattttttattgttttcaagaacaaaagacttttttgttggaaacatcagagttgatttttatgtttgcatacattagagagataatgacaggtttcttgcaaaaaccaccattacgtctcataccagcctctctgatgtttcataattttctaaacatatttcagagttattggcaagcacaaaactttgcaatttaggtggatatcagaacaacttgacaattttcctcatgttttaaagtgaaagtcatagaaacacaacagaggaaatctgccacttgtaatggagcaaaatctttacttgagtctttgagagattgtctcaaccagatcacttagatcctttagtccctaagttataaacatgcttatcctttagcttagtttattagcatagatgaaaaagcactttcagaaatttgccttattaattcttctaaattaaagctgactcccttctttaaaaagctgcacttttctaacttcaggtgtttccttctcagagagaagatgtatatgattctatttccccacctatgaggccagcctgtgtgcctcgtctcctgaacaatcattacccgacttgggcctgctcaccagattgttggatgttgaaaggacctggtctggggccaggacactttaggaatctctgctgtgctcatgccaaactcttggcaggaaaccaggctgggcgctccaggacccagtgctagaggccaaaagaccggtctcttctatgatgcctggctcctcaccaggcaaagttgcgggggctggggggtgggggtctcttccattgctgagattctgcccccactctcttgtgttggttgagagagctgtatccagtgaccgcctacgtggctaccatttctaaaacattgtttatttcatcatttaagatttctatttgggggcgttttatcacatacatagcacatttaatcacagttcatgtgcataaatatataaagtttaaaaatatataaaggatattcatgtataaaaatattttctgatgagagttcccaatcaaaaaagtttggataccactgttctatgagcaaaagttctggaaaaggtttctatgtccttttcccagaagcaattaaaaagcttatttctgagacacaagaaccaacttgaaacagctccaagtggccaaagacagcataatttgagcattaatacaatggattgaaacatattaaataaatttaaaattgatacattcataataatatttttaaaataaacacattggtcatctttaaaggatgttaataaaccaattaattattctgaaaagaatcaagcatgaaacctgactttctagtgtgagctgtaccctaggataccaaatacttaatgagggaaatttcactccctctccctcactccctctccacacacatacatactcaaagaataatagaatatcatcatctggcaaatctcaaattaaataagatacaggctatgactttcagtagccactaacatcacaagaagagaaataactgaagatgacgtgcctcctgatggaagatccaacaccacctatgagactgttctgccaaaaactcaaacctgaatcagaccaagcatctaaatctcataaccaagttttaggaaatacagaggcctgtggaacaccatggagtacaataagccaaaccagactgtggcaggctcaactggaaagataatctgtttattaagcaaatgtatttcaagacaaaagaagcaggaaaaaaacctatagcttaaaagaaactcaagacatgtaagccaaatgcagcttgtggaccttttttggattctcattcaaacaaaccaaatttttaaaaaattataagacagtcagggaaatctgaacactggataacaggtaattattattactattattatttgagaccaagtctcactctgtcccccaggctgaagtgcagtggtgcagtctcggctcactgcaacctccgcctcccgggttcaagcaactctcatgcctcagcctcccaagtggctgggattacaggcgtatgccaccacgcccggctaatttttgtatttttagtagagtatggggtttcaccacgtaggccaggctaggtctcaaactcctgacctcaggtgatccacctacctcgcctcccaaagcgctgggattacagataacagataatattaaacattgttaaagttttaggtcataattttatggtaattttttgatgtctttctcttttagaaacacttactagaatatttatggatgaaagaataccattgctgtcactggcttctatatactccagtgtggggaaggtgaaaggtgtaccttttgtagtcttagaaggtataggtgaaacaagagtgggcacaattttctgattgttgtagctacataatttgtacattcagggttattgttccattctgtctcctttggtatatgtctggaattattcataataagagatttttctaaaggcttattatgcccaacagccatcctcctttgtattcctaaggcacacactagagaaaatgtttctcagaatcaagaattccaaatgctgtagtggaatccagtaacaaaattagtttgaagggacccatgaattgctgctgcaatctcgcctctgagaaaaagccaagaaaaagggaaaggcggccgtaatgaccttcatgattgacttatgcaggatttccactgctgaaagggaaatcctatagcatttagtgctctcaattaaatatttcatacaggagccataaggtgttgttgaaagaaatgaaaccttgttgtgtgccctgtttcctaatatctgctaaggcacatcctcctctggaccccaccttacatctagaggacgggccaaggcagcaatgctggggatcaggttcaatgactcttttcagtgaaatatatatacaaaaggaggtggctgagtttttgttgttgttgttgttgttgttgtttttaggggttttgtttgttcgtttttttgagacggagtctcactctgtcgcccaggctggagtgccgtggcgtgacctcggctcactgcaacctccacctcccaggttcaagcaattctcctgcctcagcctcccgggtagctgagattacaggcatgtgccaccatgcccagctaattatttttatttttagtagagacagggtttcaccatgttggcccggctggtctcaaactcctgacctcaagtgatccacccacctcggcctcccaaagtgctgggattacaggcgtgagccaccgtgcccagctgtgactgagtttttaaacaaaattttatctttctttatttttattgtatttatttttttttttgagacagagtttcgctcttgttgcccaggctggagtgcattggcgcgatcttggctcactgcaacctccgcctcccaggtccaagtgattctcccgcctcagtctcccgagtagctgggattacaggtgcccaccacctcgcctagctaaattttttttgtatttttagtagagatgggatttcactatattggccaggctggtcttgaactcctgacctcaggagatccacctgccttggcctcccaaagtgctgggattacatgcgtgagccactgcgcccggcccttgtcctgtttttttaatcttaaaagttgctgggcacatagtagttgtctttaagtgtccactgaatgaatatttgtgcatatagtatttcatagggttgggtggggaggacatcccagctgttcatcagaacacagcctagagagtgaacacaatttatttatttattttttatttatttatttatttgtttatttttgagacagagtcttgttttgttgccaggctggagtccaatggcgtgatctcagctcactgcaacctccgcctccttggttcaagcgattctcctgcctcagcctcctgagtagctgggattgcaggctcacaccaccatgcccagctaattttttgtatttttagtagagacaggatttcaccatgttggccaagatggtcttgatctcctgacctcatgatccgcctgcctcggcctcccaaaatgctaggattacaggagtgagccactgcgcctggcccacaatttaaggggcataatctcattgtgatcatgacggccaccatcgcttttgtcctctgacattgcaactaaaacattctaatacctcgagctctgagggcttttccaggtgtattcattttctggggctgccataaccacaaatagaatggcttaaacaacagaggtctgttgtctcacattctggggctagaagtgtgagatcgaggttgtgttggggttggttccttctgagagctgttggggaaatgtcgttgttgctggccatctttcatgttccacgtactccatctccaaataaggccatattctgaggtgttgggtcttaggacttccccatatgaatgaggaaaggaggtacaactcaacccctaacactgggtggcccttccttcccaaggcctctctatcctcagggacaattgcattcgtttgaaccccctgtcttcccaggaaggcactgggctacaaggccccaagctccctttctttgcctgttggcaccaacatcaccctcccactcttgctcctgaagctttctcaacactgctgtggttaatgttggctttttggctcttggtggcctggtttgtggctgctactttcctgtcattatagtagtgttctcagctctctcttcttttcactgcaatagtccttaaacccaaagaagaggttttcccttgccagcgaacatcagtggcctagccttatactggcaattatattccttgggcccctttcaaaagataggctgctcttttgaggaagttgggatatgggatctagaaaaatatgggcagagaatagagtatttcttccgtcttgccctggagctcttctcccaggatgagactaattttccttttggttttcaagacatgttatgtctctgcttcaaggtaccccagtcaccctaaattgggggtagccttcatcacatttttgtctgaaattcttcttcttctttttttttttttttttttttttttagatggcatcttgttcttgtcgcccagcctggcacgatctcagctcactgcaacctccgcctcctgggttcaagagactctcctacctcagcctcccaaatagctgggattacaggcatgcaccaccatacctggctaatttttgtatttttagtagagaaggggtttcaccattttggccaggctggagtacagtggtgcaatctcagctcactgcaagctctgccttctgggttcacaccattctcctgcctcagcctcccgagtagctgggattataggcgcctgccaccacactggctaattttttgtatttttagtagagatggggtttcaccgtgttagccaggatggtctcgaactcctgacctcaggtaatccacctgcctcggcctcccaaagtgctgggattacaggtgtgagcgaccttgcccagccaaaattcttcatcttgttgctccaagagtttgtaatttccccaaatttactaccccatttttccaagaatctgaggggctcactgatgtgcaaaacaggtgtccacgagccccaactatatgaaaaacatcttcacataaccatcatccctgctgtttggagtctggcctagagaagcatataaagaaaaagccttaccctttcagatatgtaaattagacttccagccacaacggctgcgtccttaatcacagtgtttccggtattagagctagaatgatgacagtggcaggatgacaattccttagctaaagagtgtcaagcattccagcctggccaacatggtgaatccccatctctactaaacatacagaaattagccgggcgtgatggtgtccctctgtaatcccagctacttgggaggctgagacaatagaatcgcttgtacccaggaggcagaggttgcagtgagctgagatcacgccacagcattccagcctgggtgacagagtgagactccgtctaaaaaaaaaaatagtgtcagctgggtgcagtggctcatgcctgtaatcccagcactttgggaggccgaggcgggcagatcacgaggtcaggagatcgagagcatcctggctaacatggtgaaaccccgtctctactaaaaatacaaaaaattagccgggcgtggtggcgagcgcctgtagtcccagctactcaggaggctgaggcaggagaatggcgtgaacccagaaggcggagcttgcagtgagcccagatcataccactgcattccagcctgggtgacagagtgagactccgtctaaaaaaaaatagtatcaggcatcgttagcatgaaacttgaagagacttaagctcatcttgtgcttgctaagggtaggcagctatattccagtcagcagacaacagtaacaattgcatgctgagatctcaattggaagaaaggagacaggaccaggggtaggagaaccaagcaaagcctagaaattccagtggcacagaccaggggtatggggggtaggagtgagggtgggagggagggattgatgctcctatccactaaacgccaagctaaggcagtgtgtgagtggtgagaagcttgtgaagccagacagacttgggttcaaatcccagttctgtctctcactagctctgcaagcctgcatgtatcttttcctcagcgtcctcatctatcagaaaaatgaaagtaataacagtacctgcctcacaggtctgttgtgatggacacatgaggtaatgtgtaaggacaaggcatagggcttaatacagaggcggcacccaattagctattgttattactattgttagtaaggagcccaaggtgctcgcctcctatggctctattctgctgaaggaacaaagataattcatttggctgtagccatgggcatttataggcaaagaattttctcttttcaaactcaaagtagcacatgcagatgtgttttggcactctaaaatggaggtgcattttccaattacagttgaccttgaacaacatgggggtcaggggtgccaactcccagcacagtcaaaaatccatgtataactttgtactcccccaaaaacttaactactaatagcctaatgttgactgaaagccttaccagaaacataaacagttgattaacacatattgtgtacgttatatgtattgtatactgtatctttttttgtgtgtgtgtgagatggagtctcgcttttgtcgcccacgctggagtgcagtggtgcgatctcggctcactgcaacctccgcctcccaggtccaagtgattctcccgcctcagcctcccgagtagctgggattacaggcatgcgcctccacgcccacctaatttttgtatttttagtagagacggggttttgccatgttggccagaggctggtcttgaacacctgacctcaggtgatccaccctccttggcctcccaaagtgctgggattataggcatgagccaccgtgcccagcctgtatactgcatctcacaataaagtaagctagagaagagaaaatgttattaagaaaatcataaggaagagaaaatatatttactattcattacaggaaaatggatcatcatgaaggttttcttcctcctcatcttcacattgagaataggctaaggaggagggattggtcttgctgtctcatgggtggcatataagtgtacccacacagttcaaacctgtgttgttccaatggtcactatatcacatttcattatcaccctctcttcacatccaatataatatggttagcttatcaatttcacaaaaataaaacatcatccacaaaatgagaatggtgtctcagatgatatggcgagaaggaatcaagtcagaggagtttctctgattgagggccttgagacgggcagtcttttcctcgtggctagaaagggtgaaactctagctacagcttcctggtagaagggctgttaccatggtttctgaagcaggcgtggagtcagaaataccatttttttgcatttatatatggaaaagataagacctcacttttgtttttcttagcatatctttagaaaggcaacagcaggagaatagaaagtaggaaaagctagtgataagggttactgaattggccaggcgcagtggctcacgcctgtaatctcagcactttgggaggcggaggcaggcggattgcctgagatcaggagtttgagaccagcctggccaacaaagtgaaaccccatctctagtaaaaagaaaatacaaaaattagttgagtgtggtggcgggcgccagtaatcctagctactcaggaggctgaggtaagagaatcgcttgaacccgggaggtggaggttgcagtaagctgagaccgcaccactgcactccagccttggtgacagagcaagactctgtctctaaataaataaataaataaataaaagaattactcaattaaccccaggatcagaagagaaaagttacttctttttctgttatacctataagaattcataattcatcccaaaaaatcaattgacatattgtattttttattgacttatctcgtttttgttttttttctttttttgagactgagtctcactgtgtcacccaggatggagtgcagtggtgcaatctcggctcactgcaacctctgcctcctgggttcaagtgattctcctgcctctgcctcctgagtagctgggattacaggcacatgccaccacgcccagctaatttttgtatttttactagagaccagtttcaccatgttgcccagactggtctggaactcctgacctcaggtgatccgcccgcctcggcctcccaaagtgctgggcttacaggcatgagccaccatgcctgacctgatttcccttcttgactggttttggttcatgtggctggtgcctggttgcccgtctccccagggctctccctacataggcgaactgaaggaaatcacacttcttgtctttctctctgaagcatgttgaaccagctggaacctgtctttctctctgaagcatgtttctttctccaatcaagagagcctgagtttctagccatagtgtgtagcatgaagcacataactttgatcagggtttatttctgttacatcgagggagattttgttctgttaaaagttgaggacatattattattatttgtttttgtgaatctcttttgcatttttgatcagagacctaagaaggggacactacaaagaaatgaaaacacagtttttgtgcaaaatggtgactcctgtgtgtgtctgtgtgtgctggggtggggatgggactggtggtgtgcttgctgaatgtaagtgccaggctgcttccctcaacacttcccagatatattttcaagcatttcatctctcattgtgtcctaaaccttaaccgaaacccacaaagtattagaatctcccttcaggagatgagttttaaaacctccattctgaatataattctgacacgcgtggaaaggacaggaagcatgaaagtttagcctgaactctagttcctaggactgaacccacgccaaaggcattatttcttttgttattattatcctttccagataacatccttatgagtatctttaaaattacattgtaagccagaggtaaggcaagctctctctttctttgcccaatatttttattgcactttgcagtcactatttcagcatccgtctcatcactcatggtgccatttcacttcagcatgcctggtactgcaggtggcacttggagattcaagagatcacagactcagccgggtgcggtgactcacgcctgtaatcccagcactttgggaggctgaggtgggtggatcacaaggtcaggagttcgagaccagcctggccaatatggtgaaaccccatctctactataaatacaaaaattagccagacgtggtggcgcgtgcctgtagtcccagctactcaggaggctgaagcaggagaatcacttgaacccgggaggcggaggttgcagtgagccgagatcacgccactgtactctagcaggggcaacagagtgagacgctgtctaaaaaaaaaaaaaaaagaaaagagatcacagactctgcccggggtcaccaacactctcaaggagggcatgaaggtaagaaaaaaaaaaaaaaaaaaaaaacactgcattgaaacaagggttgtagcagaggtaagcatactctgatgacttcaggtcaggcttgatcctactgcagtggttcttacccaagggggacccagggccctattctaataacaaacgtttggcagcatctccttaacatcctgaagaagaatttatagaaaatataacttgtctgcacacctccaaaaaatcagaggacatttagggtagccaaaatgcccagtatgatactataatggtggatacatgtcattatacatttgtctaaatccacaggatgtacaagatcaagagttaaacctaatgcaaactatggactttgggtgattacactgtgacaatttaggttcatcagttgtgacaaacgtactactcttgtgtgtggtgaggggggcggtgttgataatgaggggggctatgtatgtaggggacctggggcatatgggaaggaaatctctgtacccttctttcattgttgttttggatctaaaactactttttaaaaaagtctttcaaagatcaatataggccgggcgcagtggctcaagcctgtaattccagcactttgggagggtgaggcaggtggattactggaggtcaggagttcgagaccagcctggccaacctggtgaaaacccatctctactaaaaatacaaaaattagctgggcatggtggcacacgcttgtaatcccaggtactcaggaggctgaggcaggagaaccccttgaacccaggaaggagaggaagcagtgagccaagatcacaccactgcactccagcttgggtgacagagcagaaaaaaaaaatacatcaatataatgccctgactgtaatatgaaggagaaaactaatgaaagtaatctaaaaaaagtcatgcattttaatatgcaaatattccagcacaactacacagaaagacagaaaagccagccacttgtgcctgcttatatttaatatgtttgatttaatttatatatattactttactattttattacatttcaatatatttaaattatatttaatatgacaaaatattttaatttatattcagtggaacatatatatatatatatatatatatttttttttttttttgagacagtcttggtctgtcacccaggctagaatgcaatggcatacacatggctcactgcggcctccacctcctgggctcaggtgattgtcctgcctcagcctcctgagtagctaggactaaggtgtgcaccactatacctggctaatttttaaattttttgtagagactggggtctcaccatgttgcccaggctggtctttaatttctgggctcaaggactccttcagcttcagcctcccaaagtgctgagattagaggcatgaaccaccatgcctggccaatgcaatatttttgacttttaaaatatttaacattttgaaatcagaattaagttattatatatttcacagtagtatattgtgaggttttagatagagagagccatagaatgtctaggaacatagaatgatgtgatgtgtctatgtggtgactcaaatagcataaatggcattgctcttcctgatgtgatgtttttgcaatgaacaactcttagtaaagtttggaacaatcggccgggcgcggtggctcacgcctgtaatcccagcactctgggaggccgaggtgggcggatcacgaggtcaggagatcaagaccatcctggctaacacggtgaaaccccgtctccactgaaaatacaaaaaattagccgggcgtggtggcgggcacctgtagtcccagctactcagaaggctgaggcaggagaatggcgtgaaccccggggggcggagcttgcagtgagccgagatctcgccactgcactccagcctgggcgacagagtgagactccgtctcaaaaaaaaaaaaaagtttggaaaggaaaaaatcaatttcccctgaacttatatcagaattgaatacctgataattcaatgtatactaaaatcacacaagagaaagctctgtgtttcatgtaaagtggagttcaattctaagctctgctaattctaatttatctccatgaattcccagaaaatcatcttaaaattttgtgtgaggcaatacagttcttcgttgagcagggcagtccacatactacaagacatactttatccctggaaccacccatcaaatcccataacattccccaaacaaccaaccaaccagaaaccctccgtaggtttctttcttttttttctttttctttttttttttttttttgagatggagttttactctgtcgcccaggctggagtgcagtggcacgatctcggctcaccacaacctctgtctcccgggttcaagtaattctcctgcctcagcctcctgagtagctgggactacaggctcccgccaccatgcccagctaattttttgtatttttagtagaaacggggtttcaccatgttggccgggatggtctcaatctcctgacctcgtgatccgcccgcttctatctcccaacccccataggtttctaaaatacccaaggaggcacctcatccctagtgaaaatccctggtctgagatctcttctagttccgaaattatgtggttctttttatatgctatatccccaaacttaatctaattaattatttgtaatacctattaagtgccttaccattgaaggaggcaaaaataaccttgtgtcttgttcctttgcaaagatttttacaggcttatccctaatgcccagcacagcccaacacgtagggtctcaataagtacttttggatgtatgcatatatatggggaggatattccagcagtataagacatgaacattttccttacattctacattgccacatttccaatacattctaattgggaaattaagaataacatgtgacaacagtaaaagatcagtacaaaataatatttcattaaggggtgcatcttgtcgattaaagctgtaagtataataaagtgataagagaaattactgagaaactcagagaagctttcataatcagtagaattggagctaaggcatgaaggaagggtggaacttgggtgagaaagagggaaagctttccagaggaactgagaggaagcagggcccagagtcaagaatgtgcaaggtctgtgtgcagaaagggcaacaaagttcacactaacgaggagtggaaacgttaggatgaggtattcaggggccagatttagaagggactggaataccaattagttgaaacttgttatttgaaaagttttaataaaggccaagctatgcactgtcttagaaacccaagcaaactgcttaccttggggggtaaaatgagtgtggatgactgaggaccataccattggaagtggtagaatagaatagtggttacacacttaaatttcaagtcaaataggcctgggttcaaattctggctctgcctctactaggatcctgacctcttgagcttcagtttccatttctagaatgaagcaaataatagtggctacctcagaggattattataaagataacataatatggtgcatgtgagatgtttggtgtgtcgtaacaatttgattactgattaagtgttggtgacaaggaatgttagctgtatatatatctccagactcgctgggaggctgctgagggtgtggggaagggtggggagaggatcctaggagtaatgccctctatccttccttttattatttgggattcatagaaaagctattttcagggggtgatgattaaggaaagttctttgtgaagacatgattttctgtctcacttattgaacttagtgtttgttcataatttgttacttattttgttgctttcaaagaaaggaaaatatttgcgacaatgacttcctatatgtctcaaagggtgtggcacaactactgcatacaatgaaaactcatgatttttctttccttgcagtgcaggtgagaaaagacttctacagagagggtgagctccttaatttattttatccaatctttagcgatattatttgggtcagcatttctaaagttgcatgaatataagaattagctagaatacttgttaaaaatatagatccccagaccccttctctggagagtctagttcagttaatttgggcttcttgctaaggcaattgtaaaatgcagtgataatagctgatgattactgagtgtctaccatgcatccgtcacagttcgaagttctttttatgtataaactgagatccttgccataattttaagaggcaggtactaataccatctccatattagagatgagtagctaagcagaaagaggctaagattgcagagctagtaagtgaaagaaccaggatgtgagccatctagcctggctccagagcccatgcttttaaccattacccttcccagctccaccttatatacagatgcctatgctgtagtttgaatgctttcttcacatcaccagagcaagtaagggtgatgttctgttttgcacatttggtaccacatttaagatagaaatgcttttttaagggaagtatgtaaaaatatataggagagaaaaaaagttgttttttgtttttgtttttgttttcaagatggagttttgctcctgttgcccacgctggagtgcagtggcacgaccttggctcactgcaacttctgcctcctgggttcaagcaattctcctgcctcagcctctggagtagctgcgattacaggcatgcgccaccacactcagctaattttgtatttttagtagagacagggtttctccatgttggtcaggctggtcttgaaatcccgacctcaggtgatccgcccacctcagcatcccaaagtgctaggattataggcgtgagccaccacgcccagccaaaaaggtttttaaaaaagaagaagacattagctagctgtgagataacttcaactgagctaaatatgtgtaattgaagtccctaaaggaaaaaggaggaatacaaattacttgatagaggaatggccaaatttttttgaagattgaggacaaccataaacctacagaaccaagaagttcaatgagccccagatacaaaaagcacacacaaaaaaactaaatagtgcatattataatcaaattgcctaacgccagtgataaatttaaaaaatcttaaaagcaactagaggaataaaaagacacattatctacagtgaaccaaagataagaatgacagcagacttcttgctagaaacaatgaagcaagaaacagtggaattatacctttattttgttttttgttttttaatttttgagacaggatctcactccattgcccaggttggagtgcaatggtgcaatcatggttcactgacaccttgacattttggactcaagtgatcctcccagctcagcctcccaagtagctaagacaacagacacacaccaccacattcagctaattttaaattttattttatttttttaagatatagggttttgctatgttgcctaggctggtcttgagctcttgagatcaagtgatcctcctgcctcagccttccaaaatgctggcataacaggcataagcccagccaaacaatacctttaaagtactgggaaaaaatcctgtcaatttaggcttctacaccaagtgaaaatatctttctaatataaaggaaaaacggatatttttttcagacagataaaaactgaaagaattccccacaagcaggcctgcattacatgaaatattaaagaaattccttcaaccaaaagaaaatgataccacatagaaatctggatctactcaaaggaatgaagggcattgaaaatgttttcatggttagagatgacagtgcgtatctccttgatcttaatggagctcctcaagcattgaaccattttctacatggacacagcaataaatttagcactgatgtctgatgcgggatattttgcagctaactcaaattctattttgccaactttagtactgttgatcctaagtcatccctcaaaggtataagcaaccagcttagaaaaaggttcaatgattgatgctttcaagtagctttcagtttcttgaagataaacttggactcattctggtcttggcaaagaccaaactttttttctttttcttttttggtgagacagggtcttgttctgtttcccaggctggaatgcagtggtgccatcatggctcactgcagccttgacccccaggcctaggcaatcttccaccccagcctcctgagtagctgagaccacaggcatgtgccaccatgccaagttattttttttttatacaaggactcactcttttgcccaggcttcaatcctgcctatagaatgggaaaaaatatttgcaaatcatatatctgataagtggttaatatccagaatatacaaagaacttctgcaattcaacaacaacaaaaaagcaagcaacttgattttattttgtatttttgacccctgaactttttattggcctcctgctcccaaaaggtaccttgcttctgctggcttaatgtctcagaactctcgtctcattgatctcagacaccactttgctgtccactatcttgcgggtggtggtcttttggatggtttgcatggagttgctgttgtccagggcatcaccaagattgaagtcctccccgtcatccagcaggccatggtaggtggcgatctcagcctccagcttgatcttgatgttcagcagggcctcatactcctgggcctgatgctgtccctctgcctgggatgcagcaggaccacctccaggtgcatcaggaccttatcaagctgcatggtgtagcgggcctctacctccctcaggctgttcttcaagctagccttcagatttctcatctagtccaggtcgatctccaaggactggactgtacatctcagccctgtgaacgtcatctcagcagctctgatcttggaggactgcacagtaaccactgtggtgctctcctcaatctgctgggaccagtacttgtctagttcctctcagttctttcgagacagctcattgtattgggcctggttgtctgccatgatcttgctgaggtcctgagatttgggggcatctacctccacagtcaacccagagctggcaatctgggcttgtaggctttttacttcctcttcatggttcttcttcccgaagagcaactcctccttgaaagcctcaatctctgtctccagctgcagctgagtgacattggtgtcatcaatgaccttgcagagcccacggatgttgctttccacagactggcacatggccagctctgtctcatacctgactctaaggtcatcagcagcaagatgagtgttgtcagtctgcagagcgatgctagaattgtccacagtatttgcaaagatctgagccctcaggtcctcaatggtcttgaagtaatgtcccagactctgacctggggcccgttgttctccaggtgctcccagattttgttctccagcctccaattcttagtctccatgctcctcaccctgtccacgtaggaggccaggcagtcattcaggctttgcatggtcttcttctcattctggatgccccccattcctgccagacccccgcccatccccatggccaggccactgaaccccaagccgtcccggaagctggtggagcaagacacggagatccgggaaccagaagcctcggcccctgcatagacactggacacggttctgatcggctgggcaccgtagctgagcagctgggtggagcccagggaccggtagttggtggagaaggtggaacgagtggtgaagctcatgctgtccgggaggagagcgagaggacaggactcaggttttgcctacaatgcaacctgatcttaaaatgggcaaaggacttgaaagctatttctccaaagaagatatacaaatggccaatgagcaggtgaaaagatgccccacatccctaatcatgagggaagtgtaaatcaaaaccacaacaagatacccccttatgcacaatgtgatagctataattaaaaacaactacaacagaaaataacaagtgttggtgagaatgtggagaaattggaacacttgtgcattgctggtgggaatataaaatgatgccgctcctgtggaaaacagcatggcagttcctcaaaaatgaaaaaatagaatttttaaaaattaaaactttaaaaaatgatccagaaattctgctcctggtatatacccaaaagaattaaaagcagaatctcaaagagatatctatgcactcatgtctcatgttcacagcagcattagtcacagtagtcaagaggtagaagcaacacaaatgtccacctgtggatgaatgaatggataaaatgtggtatatacacacaatagaattttatttggccttaaaaaggaaaggaattctaacacatggtactgcatggatgaaccttgatgacattatgctaattgaaacaagccagtcacaaaaggacagatattgtatgattcacttacatgaggtacctacggtggtcaaatttgtagagcttatagaaagtaaaatggcgggtaccagggcctggtggggagagggaaagggagttgttgttcaatgagcatagagtttcagttttgcaagataaaaagagttctgggtatctgctgtgtaacaatgtgaatgtgtttactactgaactgcacacttaaaaatgattaagatggtaaattttatgttatatatacttatcacaactttaaaaaagatggccgggcacggtggctcacgcctgtaatcccagtactttgggaggccaaggtgtgcggatcacccgaggtcaggagttggagaccagcttggccaacacgcagaaaccccgcctctactaaaaatacaaaaattagctggatgtggtggcgcatgcctgtaatcccagctacttgggaggctgaagcaggagaatcacttgaatctgggaggcggaggttgcagtgagccaagatcacgccactgcacgccagcctgggaaacagagcgagacatcatctcaaaaaaaaaaaaaaaaaggaaagaaaagaaaagatatttcatgccatgcgacactcataaaagtgattcattatttagttataaaacaatgacatctgagattgctttgaaaaagagaactgctcacgtcaagagtcagagagatcccagggttcacttctgattttgtcaatgatccagagtgtatgaaatgcaattattgtatcttttcaggatttgttcaaatgctattactgctttgtaaaatatctgggtatttggggtgtgaataggataatatttataaaactagagtctctttaccaaaaaaagagtttaaacagagaaaaaaatgttatcagtagtgtcattatgctacttctgtaaacattatcatattattaaaaggaaatctgtctatataactaggctgggctagatatctaagcgtgataggccctttgttacagcaagtaatatttagtttccagaaaccagtatttaaaagcctgctttgtacaactgttaaagtctattattagaaggatttatttttggcactggatcctggagctttggctaatagcagtcaatggagtaattctagcctaattttgcaagtgttctaatgacagtgaaaatatgttacccatgaacataatgacgctcagcaaaagagctcaacattttattgagccataagagcataataattgcagttcccattttccataatcatgctttgtggggaatgtttttatttggagaaatgcaatcatttttggaaacaaattccataacaattaatatccacataataaaaatgcattcaattccagaagtttaattccagaagcctagattcaaattccccagagaagtttttatcttgcgatcttgatactaaaggaaataatcccaacaacagccagtttacaagtggaattgtttagatgatccttttaaattaaaatttgcccatttgagaatgaaatgtcatttattcctgtttcccagtcaactttctttttacataccttatcagttattttgcatgcttagtttttatgctatctcagtagtgaagaaggaagaacaagggaatcacatagcagaaacaagggtcctttgccaaaacaaaaaaaaaagaaggcatagattataaactagaagcaagaactatgtcttcagcatacagagctcatggtgctcagcattttatggtcattagaaagcattatttaaaattaaatgatttttaaaagcactttaccacgtggaaaattttttaagtattatttttgttactcagagcctgtggctttctaaattttagcaatttttttaaagggaatattaatgaaagtgagaccattttaaattaaggcagttaaggaaaatgacaatgaaaacctctctgttgactgtctttcttaccttaccatttccaaattgttgttcatttgtataatctatatgagaaagagctgattcaatggaattgcttttataacaacagtatacttcattgaaatgattatatgcaattgattataaactgtttgttatttctatgtcaattatttccctaagcaaacactttcattcacgtaaggcttatgtaaaatacagccttctgttaattgttagaagcattacaaaacacatataacaatatcagaataatttatttaatgctactatatttttaaaaagtgaaccacaatctcatgagatagagatttcaatttttcacagtttccttagattgtgaaataagcaccatctacatctgggcaaagaaagagaagtacagatgaagaggaaatgtttcctattctttcttcggaagtcgtttgtttacatgaaaaaagtttctttgcaatgaatccgattacattccatttgtatatttacatgtttatctcctagaaaacaagaactacacagtgtaggagaaaatcatttcaagtacattgtgggtcagaactgtgcgcttatcaaaacaaatgatcatataaaatagttctaaatcaatctttatttttcaatatatccttactatatttacagaagttactgatgtaagtcataacaaaatttgcaagctaactttacatttttccaatagatgagataatttaaagatgtgaagatacaaaggcagctgctgcttcagatgactcagagatggagccctgaggtcattccccaaggagggagaaggtgagaattcctgtcatcaaggagactgaggtggcctggctttgagtctcacattgttttttttcacctacttagttgagacatttgtcttcaaaactaaaccttgttgagagagaatgggtaaagatttcagatcatctccactggttaacatactaagagccaggactagaagacaggaccacagctgtatataaggcagtctcatcaagtcaggagaaagttgggctattctttgaatccagggacattcaagggtactctggagtccagaagaggggagctgtgttagatgagtagagggaaaagctaagtgcagaagggttcttgcccccacgttttgcatggtttcctagaagaaaacctctcagcagtgtgccctggcacaacctagggttgccaaggccaggcagagacaggctgagttacctttcttgagtgactctgtgtggtgtggaagggacctagaagtgcctgcatgcccttgggcaatataagagaagctgtttctgggaagcttgctagggtgggtcaccaaggctagggcaaaaataacatgtgcccaaggctacagcgaggaccgcgcaagccaagggatgaacaggcatcaggaccagaccctagagctctactgtgtccctgtcacagcaagggacaacatgatgctgagtcagccaggatgacctcctggcaaacagaccacgatgatgtctgtgtctaaagccagagcctccagcctgaggcagcatcaggagactcaaagggcagtacatgggccctcaacactctctgataccccatcctccactttcccatcgccaggacacgtgtcatctcacgtgtcatcttggggaagaaagggagatgaattaaaaatccaaaagagacaatttcatcttggaagagactatgttacatgtgaaacattgtctccttatattgttgaataagttggaattgaccagatttgactaaatgtagtcttcacctcttacccagagagtaggattttggagggatactagatcaattgcaggaaagtaaaaaggcttttctttgtacagagtgtagggcgcaaatttacaacactcctgaatgactaacaaataatccccaaggccattgctggtggcttattgtcacctgttcctctcttccggtggagcttcttccaattagtcccaaaatagccagagacctgtgggccctcccactcctccgcactgtgatccctctcatttagtgggtaatcacctccagaactgactggtttgtttgcaaccggaggctggctgaggtgcccaagcaggagctgcctgcccccggctgcgttaggaactacccctttagatgttgcactgcggggagaggttgtccaggagcaactggggtgggtgagcagttaggggctcagggcagtggctattttccaaccggtgtgggaaaatgtcagtattttaacaatcggcatagccagactggtatgcactaactgaatacaaggaagttcctaccttttctctcccacttccaatcagcctcagactctagaagcctctaactcacctcattccacctgccagagttccttctttaacacagtctcagccccaccatcatagcaggagcttgtgtggggagtaagaggagtaacaaccgcaagtgagggtcttgggaactcaccggagctgagtcaggagtaaatgtcgttaatgaaccccactgataacactgatcacattttccagagaaacagaaatataaatggtggctctatgttggaatgagtaccgctgttacactgttagattgatgtttatgggctggtgcaaacctaattactccttatgatgttgcttctatgaaaacaatacatttataagtttctgttgaacaatgtataagcaagtctttcagatacaagctcttctaatatgagactaccagagtgattacaaacaaagtatatgcattagggcggggcgcagtggctcacacctgtaatcccagcactttgggaggctgaggtgggcagatcacaaggttaggagatcgagaccattctggctaacacggtgaaaccccgtctctactaaaaatacaaaaaaaaaaaaattagctgggcatggtggcgggcgcctgtagtcccagctactcaggaggctgaggcaggagaatggcgtgaacccgggaggtggagcttgcagtgagctgagatcacgccacagcactccagcctgggtgacagagtgagactctgtctcaaaaaaacaaacaaacaacaacaacaaaaaaaaacaaaaactgtatgcataaatattataaatgctaataatttatgagacacttcaaaatgcatatacaacacaagaaagacagtttagtaaaaattagggcaaagggaaaataatgttaggaaaaataagatgaagccatagatcatttctggttttaaaatgcatgtctaggctgggcatggtggctcacgcctataatcccagtacattgggaggccgaggtgggtggattgctagagtccaggagttcaagaccagcctaggcaacatggcgaaagcctgtctctacaaaaaaatacagaaaaaaaattagccaggcatgcggtcgtgcaccagtggtcccagctacttggaggctacggtgggaggattgcttgagtctggggacatagaggctacagtgagccatgattgtgccactgcactctagcctgggtggcagagcaagaacttgtctcaaaaataaataaataaaaatataataaaatgcatgcctaaaggcaggtcctgaacttcctactaaccaacacaaagaatgcaacacactagttacgtgattcctgaggttttattttggccttatttttcagaacaacaacaacaacaataacaacaacaaaacaattgtccctagtactacaagctgagaaaaattcctcccatggatcctcaacagaggactctgtgcaatatagttacctaacataatggctaatgtttagtgagaactattcaagcattttgtctaccttgttgccttccctttcccaagaagggctcttctgagatgaggaaactaaggctcagagaagttcagtaacttggccaggccatacagctaatgagtggtggtgctgaggcttattgagtctgttggtcatctaagtccctgctgttgaccactgctttatgaacaataaccctggaataaatacagtcagttccacatgctatttcttataatgagttcaacagccaatgataaaaatgtgtgtcaacaaaggagcaggttaccttcaaactggaagcctaaagcattacttgaaacacaacttaaatttcttatattcaattcttattttgtacttcctactagtaaattactaggaatcaaaaaatatggatgttctttttcaagctataaatgtttctctagcaaatataacaggtcacattttcaaaattccgtgttttccctcttatatagatcacagctctcacacagatgataaagggttttctcactgcctgtgagaattaaagtacagttgtccattatagaagcttctttttaaaatagactgccatctttcatcaaatgtttcagctctgtggaaaataacttaggttttttcctactcgcaaaagaaatgtttccacttgaaacctgttggaaatatggaataggctatatagttccatcaaagaaaagcttattacttatttgcatagtatatttcttttgtgtcaagttgaacagtggtattaagtgaatgcccacaaagcatcttaaaggctaaggaaggattacactaaaggctaagctctgagacaggtttatgcaccttgcagggcactttccttgggcttaacatcttttagcctatctgtagaggatatcagagggcaaagtttctgtcatgaaataggactaatcaacttagttgaatttgtatttaaagcaaggttaaactgaattaagaccatttttgaaagaattgtcagatgtacctttcaacccgcagccagagaagcttctgcagttgaaggccagaaagtctttgtatggttcttccatctgcaatatcaaagacaagaagtcttcatagaggatgtaagtatgtaactctacacattgattagcccaaaattgaggccagttactctgagtaaaatgtttcacatataaaataaaaggacatctttatcttaaaggaaatgcttaggtttatgtgtagactttactggctattactaacagtatgtgagctaataaattcctacttgactgaagttactaacgagtaaagatgatataccactcctaccaaataaacactgcctggtcttagtttttggagttttttaagtgaaagtaaaatgaagtttatttaagataaagtcagttcaaagttgtatgtaaatttactgtagttttattatcttcaaacagatgaagtacctacctctatgtattactgctgtttatttactatatattattattttaatggccccccattactatagatatctatattccaaaaattgtcatgatgtatgaaccatgaaatgtcagagtagaaaatttcagaaaaacattgaggaacaatcaatgataatcatgaaataaaatctatattgatattccttaattcattctttaagactatctaactaaaacacctactattcagttccattatatgagtactgctagaatttcactttagtctctacagatttatatataatggactttgcttcacaatcttttgaagaaagtgaacataatttatacaaactgtagttgcacataaattatattgagtccagtagaaattacataattttgacttctttaatgatgtcaaaggtttacctttttctttacaatacttgtaattgtgcctagaacctgacatttcaagaagacatggataggtctaatgaaaatgagcttccagagtaaaaagaaataagaagtgacagcagccagcacgtaacccactgtcttcaatgctttccagggtatgtgctatggtgaaatgcagttagaaaagtcctaaagcttatgcctttaggaaaagtgaaatacattttagcagcactgccaagtgcttcggtatgaactgtctttctaaagttctcctccgtccttggcagagatgggaaggggagcaagatatggagggacccaggagaaggcctatttgggttgtgctcagagagagttggaggagatggactacaaaggcctctgcaaaacataagtaggaggaattactttggagttgttggggtactgcctaagagaaggccaagaaaactcgcaagaagccaggcctgaattgtaaaaattgctctcattttaatttaagaatttacatctatttatcttacatttatttatctcagaactgtggaaacatttaattctactgatctacttttcacatacaaaaacttaccagatacagcagttacttaaaaattaattcattttaatgtatgtaatcagaaaacatgcatcatacataccataaatattctacatacgattagtcaaatatagggttttccaaactcaaattgcactgattttaatgaaagatcacagtatagccaataacagacaaatataataaaattggcacccggctcctgggcactgggaaatcattccgtgaatatctgctgatttggcaagggctttagttcatgaagttcatgtcttactactactgccctaatcagttgagacagaattagcactaggtaaatcatctatgtgctgcctggaggggtttgttgagggtaagagtctgaagacagagattaaggagtcctcatcctcctaatgtgctgggcatccaggattagagctctgggtcagagaaatccaggctgaatgcagacctaagcaccactgcactccctcactttgggattaccagacacgctctgcactgaaaatttatattccagtctgcacttttacttgagcatttcatctgctactgcaaagtgaccttagtttacaatttgtctacatgtgtctaaaatagaaaggggtgccctgaaaatatgaaagttcacatttaaagactcgtgcttgatcatatgacacagtaccctcaaaacaatgattttaaggcaacacaaatttggagtttcaagtatctacctggctgatgaagggaaagatcagatcaaccttagaacgttgccttaaaagtattctgattttatttgcttcaaaatgtaattttgaagcaaatagggcagtgcaactattctgtatgatactgtaatggtggataaatgccattctacatttgtcagaatcatagaatgtccaacaccaagagtgaatccacatgtaaactatgaattttgggtggcaatgatgtgtcagtgtagcttaactgattgtagcaaatgtacactctgatgcaggatgttgatagtgaggaagctgtgcatgtgtgtgttgggggaggatatgaaaactctctgtagtgtccactccatttttctgtgtactgaaaacttctctgaaaaataaaagttaaaactatgtaatttgaggtatgtgcatgaaaacaggcacaaaagaaactaggcaatccttttctttaaggaaaatttgggcatcagtcgatatgatagtgataagtaaataagtactagttcataagtgcaaggattaaaacaaatgagggaagccaagtggagcccagaactgtaacacacaggagctgcagatgccaatgactcatcgtcctgcccagggacttccatgacatgtggacatttctgcaggcacttggaatagcttgcattttagattaaaatttggtggactgattaaaaaacaatgaaccactcccctggcatttcaaaaagaaagcaagccagacccaagaaccatggaatcaagaacagatgtggtaccaaggatagctttaattgtacattagataagacttatcctttcccattggccaaatagcactgagttctcccacttatttcacataacttgtgactaatggcaaaaaaaaaaatcctgctgttttgttgcagacaatggaacctacagagcctcatatagatatgcctaagcctggcaaacctggtatttcagaagaaaggcatttgtgccaattatctactggaatgacattagaagtctgccacattgcctcaatagcactagtcaccattgctgccctaccttacatcttcttggcctccttctgaattcacctgcaaccatggaagtcatttcccatctgaagcacctgcatctccctttctcagtctgaaggttttctcctgcaccacaggagcttgttgtgtctagctcaagcataatccatatgcaaaggagaactgtgccctcaaccaatggccaacagaagttgatgggccaactctttgcccttcatgaggacaattctgagatgtgtaccataggtttcttagagggctcccagcagggttgagcaccagttgcccacagtgaaaacccacacattaattcactcagcctttcttgacttttcccttcctggtcttgcttttctactccttcacacgggcttcctgggattacctcccaaataaactactgtacttaatttcttgtcttagggcctcctttggggattccaaagtaagacaatctcatctccttttggtgattcatctccacggcttttcctaaaggtaacatgtaagaggaagaggtggtgagtctctaagcaattcttgctcctctctttcttcctttttccttctcctttttcctgacttgtctcagacatcacataggatacaagctgagccatatatatataattttttttttttttttttttttttttttggagacagaatctccctctgttgcccaggctggagtgcagcggtgcgatcttggctcactgcaacctctgcctcctgagttcaagcaattctcctgccccagcctcctgagtagctgggactacaggcgccacacccggctaatttttgtatttttagtagagacggggtttcaccatgttggccaggctggtctcgaactcctgacctcagatgatccacccacctcggcctcccaaaatgctgggattacaggcgtgagccaccacacccagcctgagccctatatttttaaaaatacccttattgaggaaaatttgatataaaagaactgcacctatttaatgtgtacaatttgatgagttttggcatacgcataatccatgaagccaccacttaatcaaggtaacagacatagccaacacttcctaaagttttcttgtgtccctttgtttttgtttgatttttgtggcaagaacactcaacatgaaatttaccttcttaacacattttgacatgcacaatggacgaacctgaaggacattatgctaagtgaaaaaaccagtcacagcaggacaaatactgcatgattcttcttctctgaggtgtctaaaatagtacaactcatagaagcagaaaatattatagtggttgccagaggctagggggtgatggaagtggagaactgttgtccaatggataaagtttcttttatgctagacgagtaagttctagataactgctgtacaaaatagagcctataggccaggcgtggtggctcacacgtctaatcccagtgctatgggaggctgaggtgggtggatcacttgaggtcaggagtttgagaccagcctggccaacatggcgaaaccctgtttctactaaaaatacaaaaaaattagccgagcgtggtggtgagtgcctgtaatgccagctaccgaggaggctgaggcagaagaattgcttgaacccgggcgacagaggttgcagtgagacaggatcacgccattgcactccagcctgggcaagagagtgagactctgtctcaaaacaaaacaaaaaacaaaatagagcctgtaacatcaaaaattctatctcactcctcacttatgagtaagttcaatcttctgctagagaccatcgattcatgacacaaatcaaagttcaacaatttttcaaaatgaaacacctagtggtgtcccccattgttctgttgtaaatggtctagagggaagaaggcagctgtgcaccgaatcccatgaggagcacctgagatttcaagttgcggggcagggtcctcgctagagttatgagcccagcccatctccgacccagcctgtgttctctgctggcatcctccatggcttacaggcacctagcacagatttttattctaatcctgactgtgtggtggtaactaaactctctgaggccactatcagaaaggaaagtatactgacctcacagaaatacagtgaaagtaaatggagataaagaactttaatatgtatgtatgaatggcaaaaggtgatgttaggtgatccatggacttggatttccaatttgattagtggggttagttctgaaaaagaagctaacaaagtgattgtatatttaaataccattatatttttagtatttgaaccatgtgaatgaattaacctctattttaaaaattaaatcaaacacacaatttaatcaaatacacacaaggaaataaaggtcactactttgaaaagcagaacattttcttcctagtatctttttctttaaatatagttgcaggtatctcagatttttaaaaacaataagaaaacccaattatttatttatttttaatttttaattttcatgggtacataggtgtatatacttacgggggcacatgagatattttgatatgggaatacagtgcataataatcacatcagggtaaacggcctatccatcacctcaagtatttatcatttctttgtattacaaacaatccaattatacttagttatttttatttttatttgtttgtttatttatttatttatttatttatttattttttgagacggagtctcgctctgtcacccaggctggagtgcagttgcacaatctcggctcactgcaagctccgcctcccaggttcacaccattctcctgcctcagcttcctgagtagctgagactacaggcgcccgccaccatacctgactaattttttgtatttttaggagagacatggtttcaccatgttagctaggctggtctcgatctcctgacctcatgatccgcccgcctcggcctcccaaaatgctgggattacaggcatgagccactgcacccggcctgtttgtttatttttgagatggagtctctctctgtcacccaggctggggtgcagtggcgccatctcagctcaacgcaacctccacttcccagattcaagcaattctcctgcctcagcctcccgagtagctgggattacaggcacgcgccaccacacttggctaatttttgtattttcagtagagacagggtctcaccatgttggccaggttcgtcttgaactcctgacctcaaacgatccgcctgcctcagcctcccaaagtgctgggatgacaggcatgagccaccgcacctggccctacgattagttatttttaaatgtacaatacattattgttgactgcagtcatcttgctgtgctatcaaatactagatcttattcattctatctaattatatttttgtacccattaaccatcctcccttcccccttccaccccactacccatcccaggtaaccattgttctactctctgtctcagagttctcagatattttaaaagtgggagttgagaatgaagaagaagctaaaatgacctgttcaactagtacttgtttttatatttaaaatcattcaaaggatattaaagaacaagaaaatgtcaggaaaaatgttatccctttaacagtagtccttttttctgatcactagtttctgaaggtaaagcatatgaatatttgtatttatgtaaacttggctgtaatttgatcacagttctaattaaatacagtctcgtgcagtctgtatcccttctaattagatatacttttagacattaaaaatattctcctccctcattttctggtgttaaatcttatcaactaaataggaatatttttccaaagattgaacgtatgggagaatttatgcatttgtacctctggaaatgtaagaatcaaagtaagttgcaagaaaggaagttggggccaggcacggtggctcacgcctgtaatcccagcactttgggaggctgaggcgggtggatcacctgcagtcaggagttcaaggccagcctggccaacatggtgagaccctgtctctattaaaaatacaaaattagccgggcgtggtggtgggtgcctgtaatcgcagctactctggaggctgaggcaggagaatggcttgaacccgggaggcggaggttgcagtgagccaagattgcaccattgcactccagcctgggcaaaaattgaaactccatctcaaaaatcaacaacaacaacaaaaaagaaaggacgttggtatttctggaatcttgcaaggctgatttaattttattattgcttgtagtttggtaccgtattacctgtgaactctgcaacaaattccaagggcatactgataaaacactgagttctacaattatatctggggtttttgtgtaactaaaagcttggtgtagctagtcttcccaagtgttgtgaaaatacaaaaggcttttattgtgttcaagaagaattcaaatagttcacaaaaagtagagttatttgttaaagtgtctatctggttctttttagaactccattagtggcgagagatattgaagacaaacccggtgatggctgtgaaccctttattgacaccaacagggcagcagacaatcccactgatcccctcaccatttgggcctccaactgtggacaggtatttctcttcaatataatagtttgatcaaagaacaacatggacaatcattacgttttggaatgatgttaagtctagtgttgttttattgcctaatattatttcagtgaactgtggtgcagtaattcaagtcaagacaccctgctggcctcaccttcaagacatctgctgtcatttctcctctgagacctgcttgacctactcactcagcaaataattaatgagcacatactatatgacaggcattgtgcaggtgcaaacactggagtaatagtcttctagggctgccataataaaatactgcagacagccgggcacagtggctcacgcctgtaatcccagcactttgggaggccaaggtgggcagatcacaatgtcaggagtttgagaccagcctgaccaaaatggagaaaccccatctctactaaaaatacaaaacattagccagacatggtggtgcaggcctgtaatcccagctactcgggaggctgaggcgggagaatcgcttgaacccaggaggtggaggttgtggtgagctgagatcgtgcccttgcactccagcctgggcaacaagagcgaaactccatctcagaaaaaataaacaaataaataaaaataataaaatactaaatactggatggtttaaacaacggaactttatttcatggttctggagctgggagtccaagatcaaggtgctgcagggttggtgtctggtgaggtctctctttctggcttacaggcagacacctgctcactgtatcctcacatagcccttcctagtttgcctttgcagaaagggatccctggtatctcttgttcttaaaaggacactagtactatcggattagggccccacctttataatatcatttaatcgaaattacctccttaaaggccctattccaagtacagtcacattagcagttaaggcttcaacatgctaattttttggtggcgaggcgaaacaagtccataacaactgggtaccctggatttcccgtgaagaaagaattatttcttttcaataaaaagtaaattataagtatttgggttgcacactctggaaataacttaccttcccttgtttttttgttttttgttgttgttgtttagaatattttgaccttcaggagagaaagcagaactcattatttatccttgtttatggagtgtgaacagtaaagtggaacttctagagaccactaaagtttagaaaaataagttgtccacccaggtactcaaacattgatcccagatggtaaacccaaccaaagtatgtccattaaatgagaaaagaatttgtggtcacagtagactgttggtcatgaaaaatcagagagcagtgttgatttatttaaatattttttctagacatccctaaaactttcctttcctgctttctcattttgttgtcagctgggtcaatccttcgttagtggagtacttcccgatctttccaccatatttctccataaattcataaagactccaggacttttgtatttcatcttgagaagagatgatagaatcccatatggcaataacaaaatctcattgtctcagccatggaaattgtgtactccaacctcattttacctattttattttatatctttttgttctcagagatgtattgccttccaccgtagctccaactgacccaagacagttttgcgttccttcccaatttggatcctctgttctaccaaacacaaatatggcaaatgtgttgtccagtcggatctacccaggtatgagcaatagaagtttggctctcatctgtggagtcattttgaactggatggatgcattaagtttgccatcaaattactcctaaattttggaggcagatctgtgtggtggttgtctctgcagtctctgtagtcaccacctaggttcagatcatggtgctaccactgtgtgaccaagtgtaagctgcttgactcctctaagtgtcaatttattcatgaataacgtgaagaactgcagtattactatttgtcttatcttacacatgaggaactgataaagttatgaggagattagatctgagaattaatggggcttaaggcagtttacatgggcccgatggtcatagtgagaatttggcttttattctgagtaaaaagggaagccatcaaggggtttgagcaaaagagcaacatggtctgacttaaatgttaccagaataattctggcttctgagatggggacaaacctgatgggatcaaagttctgggaataaactgatgggaattagcaggccattagaatagctaaaagattatgacagcttggtcatggatggtggcagtaggaataataaagagtggctaaatcctgtaattattttgattgtagaaacaacaggattttctcacagtgtgtatgtggaaggtggaagaaagagatactaagaatgacatcaaaaattttggtgcaagtagttggaaagatggagttgctgctcactgagttgaggaagactgtggaaggaacagagttcttgcggagggagagaatcagaggctcagcttgctcatattacatctgagatgcctaacagacacccaagcggagaggtcaggaaggcagcagaagtgcagggagaacgtctgaggacaatttagggatatacttttggaagtaatcagcatatatgaggctagataagatcacctatggagagagtgcagatagaagaggtaaaaggagcatctctggaacccactaacagagtccagagatgaggaaaagcaagcaagggagaagcaaaacaagtgaggggaaccagtgaggtagcaagaaacccaggagagcatggtggcctggaggccacaggaagaaagtgtggaatgattacatcaagctaattaccatatgccttatctcacacatttatcaccttttttgttgttgttgtttgtttgagatggagtttcactcttgttgcccaggctggagtgcaatggcacaatctcggctcactgcaacctttgcctccctggttcaagcgattctcctgcctcagcctgccaagtagctgggattacaggtgtgcgccaccacacccggctaatttttgtattattagtagagacagagtttcaccctgttggccatgctggtctggaactcctgacttaagtcatccacttgcttcagcctcccaaagtgctgggattacaggtgtgagccaccatgcccagccatatttaacactttttgtggtcagatttacgatcattttacattggactattttaaggagagagtgagcaactgtgtcaagtgtgccatctgcagagcaagtaagatgaaaactgagaatatatcattagatttagcgccatgtggcggtcatcagagattttgatgtgagcaatttcagtagagtcgtgttggtgaaaacatgacttgtgagggctcaggagagactaggaggtgagaatttcctcaaaatgttgaagctcaaactggtgtatcttctatcccccccaaaaccatattcataagtttatgcttatccctgctccacaatttcaacaactcttaatagatgggagcaatgtgaagggaaagcctgacacaaaaagaaataggattcacgcctgggtcagggaagagactggcctgcctggatttgagcatgtttctaccacaggtcacgaatccatttaactgcagtgagagcaagcatccaagcaagggccagatctggaactgggcccactcagtaaattggttcaaggaccaaaggagacagtccaacagcagatcctggatggaagccagctggcagcaataacccagtaatctgcagcccatgattaccgacaacaggccaatagactagtaaaacagctgcactgcaggccaggtgtggtggctcatgcctataatcccagcactttgggaggcaaaggcgggcagatcacgaggtcagaagttcgagaccatcctggtcaacatggtgaaacgccgtctctactaaaaatatgaaaattagccaggtgtggtgtcacatgcctgtagtcccagctacttgggaggctgaggcaggagaatcacttgaacacgggagagggaggttgcaatgagccaagaccatgccattacactccagcctggacttacttaggtcaggtctccaacctcaaggctgaagtataagagaaagcatgggtgagataaggcctcagtcctacaaaaactgagctactaagtaagttagcaaaatagaaactaagacagggatctgtttacaaaacagggttgttaggtagcagtgaattatacaactgaactaacattaagtttgatattgcctgtttgggaaagagaaagtatgggagaaggtttcttgagaccagacctcagagggttctaaaatccaggcagttagtattgtgctctctagactggacttcttgcacagactttctctgtgtccgtgggcagtatgccatgaattggtagcttcatgcatgccagctgtctaaaagagagtatctcaaagctattgaactacaaaaaacctagagctttacagttagaaggattcctggtgatcacttcatctaactccttgattttacagataacaaagaacctcatttttaaaaaagatctagtatgatttctttcaagatagattattggtagaaatttaaagcactttacttgcttggtgcaaagtgagtataaaaaattgtttctggccaggtgcagtggctcacgcctgtaatcccagcactttgggaggccgaggcaggcagatcacaaggtcaggagatcgagaccagcctggccaacatggtgaaaccccatttctactaaaaatacaaaaattagctgggtgtggtggcatgcgcctgtaatcccagctacttgggaggctgaggcaggagaattgcttgaacctgggaggtagaggttgtagtgagccaagatcacaccactgcactttagcctggatgacagagcgagactctgtctcaaaaaaaaggatagattataaatcttctgaccacaaaaagtgataaatatgtgaggtgaggcatatgttaattagcttgatttaagcattccacaatgtatatacatatatcaaaacatcaagtggtacccaaaaaatacgtatacttttaaaagaccaaaaaaggcacagatcacgagattcacaaatcacttcatctttttcctattaaagtatggcaggaaaatgccaccagtcatgagaccaacaattaaagaacaaaaaattatctggtatttgtcatgctgtcaccaacgtgactctaagataccgaactgcaatgatctgataccatttccaaaattgtgcgcaattgctggtttgttttttttttttcagatactgttttacattgttatagtttattttattattttcaaatgcatgtttttaatttatttgtggggtgggatggtggttttcttttttaaggttggggcattttaccacctgaatccataaaggcagtggccagaaggaatgaaatgattcaacggcatcatactgccaggtaatttggcaatgttgttttatttattctctattcattcacttgctcatttattcacttgttatcttcatataacaaatgaatagatgaatatatataacaaataaatacacacacacaaattacttacataaagtatttcaggcagattacaaaaagaaacatagtctgctctgcctatggggtagccattctctattcctttactttcttaataaacttgctttcacttaaaaaaaaaaagaaaaagaaatgaatacaaacatgtatgcaggttggttaaggataaaagcaagattagaaatcacggccgggcacagtggctcaggcctgtaatcccagcactttgggaggccgaggtgagtggatcatgaggtcaggagttcaagaccagcctggccaagatggtgaaactccgtctctactaaaaatacaaaaaaaccagccaggggtggtggcaggcacctgtaatcccagctactcaggaggctgaggcagagaattgcttgaacctgggaggaggaggtagcagtgagccgagattgcaccactgtgctccagcctgggcaacagagtgagactctgtcttgaacaaataaaaagaaatcacacagtgaagctaacagtagtattagtacacagattgcaaaagaccatcagtgtcccataattaaaatgcctacgactcctctgaaattcatattggcattactgtcttaaatgacttcaattttgcgcaaagataggagccaagtttgcctacctgacttcagattatgccatcagaactcagacaacacccatgtcagcccaacagtggccttcagctatagtacccaggagaaagaaaagtataacaatgaatagggtatggccccagggtaagagaaggcagagtcaactttctcatcgctgaacccaaaggggtccaattgaggaccaaaaagcaaagtgaagtaagcaaaactaccgagtcttttcctctgctcttccccagccacttgcatttatttataaatattgagacttgcaatgtctaattgtctttcttgaatctcactaagattattttgcagggtttgaaaacctcttcccagtactttaggttttttgaggattaatctctggcaaggaactagctgtgctgcgtaagccccatccctgctaaatttgcctcgtctgtttaaaggtaacactctaaagactggcctttggacttccattgtgagactcagacaaagcttcagatcttactcaaaactctccttcccagtggctttgtgggggattcatgtttccaccaaacaaacttcagataaacagtgtgaggactattttagggaagacaaggggtcattaaaattacatttatagtggttttcttgggctgtataaaatatattgttttgtttttaggacagaaatggaaatgtatgctatttaccagcaaaggagaatggaaaaaattaatcccaagggactagcaggcctagggatacccttcctctatggctccagtgtcccagctgcccccgctgcctaccatggcaggagcatgctccctgccggtgacctgcattttcacagaagcaccctcagaaaccttcagggaaaccccatgctagcggcaactgcaccacactttgaggagagctgggggcagagatgtcgtcgactcaggaaaaatacagggaatcaaaaagctctagacagtgatgctgagagttccaaaagtcaagcagaagaaaaaatcctaggtcagactcatgcagttccctatgaagaggatcattatgcaaaagacccagacattgaagcacccagcaaccagaagtcaagtgaaacgaatgaaaagccaacgacagctcttgccaacacctgtggagagctcgagcccacccataggaaaccctgggggtctcacaccactaccctgaaagcaaaggcctgggacgatgggaaagaggaggcttcggagcagatttttgcaacctgtgatgaaaagaatggggtttgccctccagttcctcgaccatctctgccaggtgggtgtccaggggccaatggcagatcctcattaactacaggttgccaagtccgtaggttactacataataaactgtaaccatcctgcctctttttatctttctttttttttttttttttttttttttttgagacggagtcccgctcagtcgcccaggctggagtgcagtggcgcgatctcggctcactgcaacctccgcctgccgggttcacgccattctcctgcctcagcctcccgagtagctgggactacaggagcatgctgccacgcccggctaatttttttgtatttttattagagccggggtttcaccatgttggccaggatggtctcaatctcctgacctcgtgatccgcccgcctcggcctcccaaagtgctgggattacaggcgtgagccaccgcgcccggctttatctttctttttcttaatcctgcttggaattaccttctcttagcatcattttattctatcagtgctaataagccatatcagtgaaactagcctctgtttatattttgctatatagagaattttcaacaaaggctgggaaggtaaatatcttgggaaacataatagaattttaatttaagattttaatgtaatttagtgttcatttcttcaacaaagcagagaggcgtcttgcttcaaagtgtgaattctatctccctgatatttaagtatatgaaaaaacaggcaattaagcagaagtattacctttcagtgtccaatactgttgatactttcaaatttaaaaatactaatgcacttcatgacagaaacgcacactgaatagttttctagcactcctttagataaaaaaaaatatattttaagacacagggattgtgaagggcatgtaatacagccaccataccaactgtttccctacaaagtgttaatttgccattctgatgaaaatgtagctaaattattgtctcatctcgaaagcaggataatcacctatcacgaaaacatagtaacattaatctggagaatagaatccatggggcatttctgttgtaatctgagagaagctggtgcaaacctggaacttgtttacttacaataaatgctatcagtaaagatcttttcagagaaagaaaagaaaggaggcagctgaagcttttagaaaacatctcctagtaattcctaatatcttgtaaggcgtttgcaaatcaagaccactctggggtgatagaatataaggaaattaatgtaactatacataaacctgtatgtattttatgccacaatttctttccattttaaaggaacacatgcactggttacaattggggggaatctttctttggatgaagatattcagaagtggaccgtggatgatgtgcacagcttcattcgcagccttccaggttgttcagactatgctcaggtgacttaatgtttaagtatttccatacaagaaaaacagtttgaaatatctttcctgcataatgaattaggtcaaacttgcattgtgcctccagaaaggattcctactaatctctcttttttatgccagtgtctaccctgggacaggtctctgattggtggaacttgggtcatacacccacaccccagcatcaggggaggctgggaaagccattgtctgtctttagcttctttcctatcaagactcctaagaagtaggaattctcccaaaattagaagaaggttcagaagctgaacatccaaaaagaatgggaaataacgactacattccctacttatccacatagcaaacatttttggagcacagacttctgggtgagaagttttaggttactcactgtaagtaacaggaatatatacttcattctaaaaggaacaagaaggcaatatctgaaaagttagaaattcattattttaaattctgtatttatgctgggacaatatataaaaatgcatacaacatattcaatctggcataaaataccattttaaaaaactataatgaactatcagggcagttagaaacaaaactagcctcactagtattgaaaaatttgtgacaaaagtcataggttggtaaaattttgaagtttatgtcaatgctacattttcatgcatttagtttacttttttgagttatttaataatacaattctaagcaataaagtgcctactaaatctagtatcatttttggtttgcatgttaaaggaaaagaaagcaagaaaaggatattaaggtttaactacatcataattaactgatactagagctgattattttccagatctgttttgtgaaatgtttgtctacagtgagatactgttaactctttttctttttattattattattttttagttcagtttacgggacttacggaaaaactatatagagtagttactaagaatatagcttctgaagccagaaagtacaaattcaaatcctggcttttctattttctggttgtgtgacctaggacaagttgcctcccttctctgtgcctcagttgttttatctgtaaaatgaagataatcataataatacattttcagaggatttttgtgagcattagagtgcatggcaccttgtaaatactcaataaacatgaatttcatcattatacccaagagacggccaagcctcaagttacttatgaagcaagttgtgttcctcaagtcacccatttttgtcttttgcataacctgataaaaagtttttggcctactcttccctgttcaatggttataaccttatttttaaaaattagtcattagtcatgggtaagccactttttaaatgtatctataccacttcaagtgccatgtcaaccatgggttcaattaagttgctaacttctgataacaaccggaagagcaacccttatttaataagcatgtgattgctaagatctggcacattgaatttgaactctgattattcttagtgatccatagtcagaaaagtgcaatttataataatagctcttgtaataaataatattacatgcttttcatagtttaaaatcccaaatgtccccttgtgggtacacagaagtcacataaacatgagtactccaaactctgctgactcattatctctcactgacaggatgtcagcgccctcttccctaccccaagaagtggtagcaattatttctagatacgtctcaaatttgtttaggatcaagtcctgctttagtttccccattaaagtatactccctccaagtgacagcaggtggcatcaactgaaagatgtcactgctgtgctgtgcctgcccccagctatgctctgtgatgttattttatacagaaatggggagatgccctctggatgcaacagccctgaagcagcactgcttgtaccccactctcacaaggacgcttgtctaaaatgtcccatcaggtgttactcattgttactcatagcccctttcttttctttttttttttttttttttttgagacagagtcttgctctgtcgcccaggctggagcgcagtggcatcatctctgctcaccacaacctccgcctcctgggttcaagcgattctcctgcctcagcctcccgagtagctgggactataggtgcacaccaccacgcctggctaattttttgtatttttagtaaagacagggtttcatcgtgttggccaggctggtctcaacctcctgacctcatgttccgcccacctcggcctcccaaagtgctgggattacaggcatgagccaccgcgcccagccccatagcccctttctttaaatgagttggaccaaggtgctgagattagctggcgttaaacctactgtcccccaactatcctcttactccccatctctgccttaggtgcctactcagcaacttctcaccactcacctcctgtaggtagaaaaagaaattcagcagaaaaaaaataacaactaaaacccaaagccccaagtgcaaatgaactcttttaaataggtgtagagaaaggattggtggctcagctgttaaggaacattcaggagagcctgcaacatattttgttccaagtaaatgtctagttcagaggactcagcagataaaatatcctctctctaaaaagaactgaaattactgaaaatatgtgcacatttatatcattacacatggcccaaactgctctggtgagaaagaagggggtacatctgagcgacagggacatgtatgtgtcctcgccccaggccctgagtacatccaccatggctgagggttagatcctcacacatttcagtcccctggctgccagcctacctctgcttgaaaatttatccacgtggttcctcctttggatgctcacaaattgtcaggtgcacactaccacacccagctaattttttttaaagagatgggggtctactatgttgcccagacttgtctcaaactcctgggctcaagtgatcctccagccttagcctcccaagtaactgagattacagatgtgagccaccgcacctggctctttaatttatattagccattttctataatttgcttaattaaaataggaaaagaaataattacttaatgcagtttgttgggggacggctggctcagcgctgagagaggtggccagggaatggtgggagctgcagtggtggtggcagtggctggggtgataagcacagcctggggctgcccctcctcgggggccatgctgcattgcactgcatgggtagccacgagcgagtctaggacgcaacgggaactgtggaaggtgcatccacaaatggaccaatgtgtgtaatgatggaatctccttactaaccattaccactgcctctccttgataagtgagccagagagtgagtgggtcaggggagaagaaaagaggtcaacatgaagctaaagcagcgagtcatgctgttagcaattcctgtcatctttatcttcaccaaagttttcctgattgacaacttagatacatcaactgccaagcagcgtttcactacttgatcccctgagggcttttcaccgaatgatgactggcttgtggatggagctgtcacccaagttggaccacacgttgcagtcttcctaggagactgcagcccagtgggtggttccccaggaagtgtactgtgaagagacaccagagctgggggcaatcatgcatgccatggccaccaagcaaattattaaagctgatgtgggttataaagggacacagctgaaagccttactgatccttgaaagggaacagaaagttgttttcgaacctaagtagtatagccgagactatgtagtggaagggaaccatatgccggttatgatagacacaatgcggaggtagcagcctttcacttggacaggattgtgggtgtcccagagccctgctgatggtgggcagatccgttcatcttcagacagagatcaagcctgttaccatggagcagctgttgagccccttcctaactgtaggacacaatacttgtttttatgggaagtgttattactaccgagaaacagaatcagcttgtgccgatggagacacaatggaaaaatctgtcacactttggcttccagatgtgtggcctctccagaaacactgacacccgtgggccaggacttactgaaaaggcaaattggccaggtgggagtatgatgagcgctactgtgaggctgtgaagaaaacgtccctttatgactctggcctgtgccgcctggacaccattaacacagctgtctttgattacctgattgacaatgctgactgccattactataagaactttcaagataatgagggcgccagtatgctcatccttcttgataacaacaaaagctttgggaaccccttgctggatgaaagaagcattctttccccccctctatcagtgtggcatcactcaggtgtctacctggaacagacggaactacctaaagaatggtgtgctgaagtctaccttaaaatctgccatggcccatgaccccctctccccagtgctctctgatcctcgtctggacgccatggaccagtggctcctgagtgtcctggccaccgtggagcagtgcactgaccagtttgggatggacactgtatggtagaagacacaatgcctttctcccacttgtaactctcaataaaaaataagtgaaacttctttttacaaagatagagaagcagcacaatcaattccaaatggtatgaaatggattggaaatggccagcagcaagttctggtgacaggggacagggtggccttggatgtctttggtgttttctgtagtagaaactaaagcaaagaccacaagtttctgagcatggagatgttcctgctgaatcaccttctgaattcctcagcaattgcccattctagcaataggcatcatagttggtcagtcttaattcccaggccaaaggacaatcagacattttcatagatgaatactgggattggctctggagtgtgtgttttgagtggaacatttcagtcctttctccacaccggtgcatattgtggaaaaatatatgtatacattcatgactaaaatctattagaacacaaggttcccagtacaggagctttccaagaagattctactttttagctggtcctgagtcatgccctgtgaggcatggagcacagagtggaaacaagaccaatgtggttcctcttctcatggcactcatagtccagaagaggggcaccagtgagtgatcccacatccatacgagcacgttgtgaaaggcgggtacagagcatggtgggaacacatatgagggactcttggcctcctaaaggaagaggcctctaaagtgagacctgaaagtcaagaggagaggtgaggcaggagggagataaaggaggaatttccaggtgagggccagagccagagaaaactttaatatggttgggactttgagagtagttcccagtgctacagagggccagggccaaggtgggagaggtggggagagcaagatgagactggagaggtggacagggccaggtcacagagcccagaagacccagtgaaggattgtggctttatcctggaggcagtcaggttttaagtagggagcggcatggttagctttatattgcagaaagatcactcaggttgcttttatgaaaataagttgaagaggacaagacagaggggaagcctattcagataagcaatgatggagttctatccagggtgggagcagtgggggcaggaggataagaacacaacctagaggaggcagggcaagatggccaaaaagaagcctccaccgatggtcctcccttccggaacaccacatggagcaacaatcctcacaaaaaaaaaccaccttcataagaacaaaaaatcagatgatcaatcacagtacctggttttaacttcatgtcactgaaagaggcactgaagggggtaggaaagatagtctggaattgcccacaccatccctctgccgtcccccagaagtgaccacatggtatggggacagaatctgtgcttttgtgggtgggggacacggtaattgtgggactctgcattggaactcagtgctgcccagtcacagcacaatgaaaactatgtaagaggccaaactggcacgatttagcttctgagttaaagatacatgttagggagccttcagcatatacagcccatcattgaagctgagcaaagctgaaatgaatcaggaagaccaaagggacctgagtcagaagcctaagaaaccctaacctataaaaatggacaaagaaacaggagctggcaaaggtgaccttgaaggagagaacaggggtacccaggagggagcagcctcatgacagaaaggaagagcaagcactgttcatgaaggcacagtcaacaatgtcagatgcagccagcaacttcagaaatagaacaactgcaaaatgtctgcatgtttggtgggacagaggcacccggaagcctgaggaaagccggcttaatggaatggtcggggcagagctcagattccctgagactgcagaatgactgggaaattagaacgtgaaagcagggagcatcgaaaccctttggagaaatctagctgtgaagggagtgagagacatgaggcagcatttggaaatggagtttgagtattttcattatttttgtttgtttaatgatggtggagacttatttaaatcccaatgggaaagagccagcagaagaggagagactgaagagaaaagagggaattatctatcctctctggaagtgggaggcatgaggacccacagtatatgtggagagatcgtctttaaatggtggagagacctctcttccattgtatcgtgacagtgggagaaaataaaggtttttggttcattggtcagaattagagggagttcttatctactggtttttgttttctgttttttgttttgttttgttttgttttgtttttttagttaggaagcgctatgatctactgaaaatgagggaaggctctgcctacaaagtctaaagtttgaggagggtggagatagcttgaaatagaagggagagaaagctcaactgtgaatatagaaggatttccaggcaagttgaagttgaagatcatgaaattacggtcctatcaatctgcctagattttgtatccctctatctgcctggaatctttgtccaccagcagccttcctggctttcagagaaaggaaggcacgccacgtccactacagtttcaggactaacagacctgctggaaaggtccggtagggaaagttctcagcagcatttccctcccctccctttaccaagcatctaaggcatggccagcagataccacatctgtaaatgtgagacatgaaatttatccataacaggttttacccacatccctttacttacagcatttactcattcattcatttatccagcaatatttattgtacatcttcttaccatatgccagcctctgtattaggggtacattggtcaaaaaaacactgacctggccctcaaataatcactattcctggttggaattgagttctataaacagagaattacagtcgattacaaaggttattaaagagcacaagcaatatgctactgagcacagaaaagagagcaactaaaaaaaggttttacaaatttttttgtcatcctcaagcagtcttaatgttttctccaaaactaaaatatctaggtggtaaaagaactttttcaaaaaaagacattcagacagagttaacaccttttgtatttatgaaggtatttaaagatcatgcaattgatggagaaactttgccattactcacagaagagcatcttcgaggcactatgggattaaagctagggccggcactaaaaattcagtcacaggtatggtgattttatataactaattatgtattaatggcacaaagcttaatacaaatatgttacttttatcttgttgtaatataaataatacttatttaacttctttattgctttccctctgtggttgaggacataatagaagtgagggaccctgaaaacattggatgggatggtggtacacattcctagatataactgggaagatgataagcaaggatgcactggtaaatgtttaacaagtagttctctttgaaaaaaaatgagccccaatttgtaatatctccaatttctgtggtgtaaattactcccaccgtggctgagaaactcctaatgtcactgaatactgtcatcctccgagaaatcatcatcccactcgggagtgctgccctcctcgctccgggcccatgacacttgggggtgactatcctgaaatgggaaaagatgcatagcagcaccccactttagagtatttctaccagatacaatctcaaatataataggtgtgaataacgtcaagagcagaagtaataataatagtaaaataattaggtaaaaacaattaaaaagtgatgagccttaagcatatattacttttgttgtacataatttatttaatatgatgctttgacttaatttttaataatgatgtatttaacaactggcttgcaaacttcctaaacattgaataattggctcttgtgagttagccaaccccagcacgccacttctcactacctccaccactccatcctggtctcaggcaccatcatctctcattggatgactgtattggccttctttttttttaattttaatttttattttaagttatggggtacatgtgcaggtttgttgcacaggtaaacatgtgccatggtggtttgctgcacctatcaacccatcacctaggtattaagcccagcatgcattagctatttatcctgatgctctccctccccccatcccaacccctgacaggcctcagtgtgtgttgttcccctccctatgtccatgtgttctcattattcagctcccacttataagtgagaacatgcggtgtttggttttctgttcctgcattagtttgctgaggataatggcttccagctccatccatgtccctgcaaaggacatgatctcgttcctttttatggctgcatagtattccatggtgtatatgtaccacattttctttatccagtctatcactgatgggcatttgggttgattccatgtctttgctattgtgaatagtgctgcaatgaacatatgtgtgcatttatctttgtaatagaatgatttatattcctttgggtaaatagccagtaatgggattgctgggtcaaatggtatttctggttctaaatctttcagaaatcatgcattggccttctaactgctctccctgcttctgcccttgcccacccagagttgattcacaaaacagtaaaagtggtccttttaatatgtaagatggattgtgtcagtcttctgctcaagattctacaatagctccccattgccttcagagccaaagccaaagacctatgtcatttgtgctcctcctaacatgccaccaccattaccgtcctgacctcaccatctacttttctccccctcagtaattccactattgctcagctgcccctggttagagccaccttgataccctgttttacatctgtaaacactataattctgagagaaagaaaaagcccaccacatcctacaattgtgacccccacaactatatgttaatagatgctccatgcctgaaattacctcagcctctctgtgatgtgtgtttaatgctgagttaatgaaaaaaattcatagaattgattactataattattttgtcttaaaaggtatctcagcatgtgggaagtatgttctacaagaaaactctttcatttcctataagacaagcatttgatcaaccagcagatacatcccctcttctggatcctaattcctggagtgatacaatgaacattttttgtccccaggatacaataattcctaaaggaattgagcgaggtagtatgagaaactaaaagccctcaaggaggaagaatagtcttagccagttttccaaagagcctaggatattacaaaggatgtgtgaggatttcccagtactggatggagaatgagaagagaaagtcagcctttctggggctttcatggaggagacttgcccaaggggcttccctgccagggctgaatgaccccagcaccaaatgactggagacgcatccttaggagcaaatgctaatgaaggggagatttacaaacatcaagaaagctgcagatggatgtttccatgaagaaatctctgaagaaaccaaaagagctgaaactgaaaaaagagctccctcccttttttcactcattttccattcccaaaccctgaaagagataaaggcaacccaatgaaaccacagagaggcagaagagaacgggcagaagtacagaacagaaatggagaagctgaccacgactccatctcttctcattccagatttccagcgtgaagcaggcccaagctagggaaggtgagaagctttaaccttaaattttcgagttttggccaggcgcggtggctcacggctgtaatcccaacactttgggagtctgaggcgggcggatcatgaggtcaggagattaagaccagcttggccaacatggtgaaaccccgtctctactaaaaatacaaaaaaaaattagctaggcctggtggtgcgcgaatgtagtcccagctactcgggaggctgaagcaggagaattgcttgaacctgggaagcggaggctacagtgagctgagatcgtgccactgcactccagcctgggtgacagagcaggactctgtctcaaaaaaaaaaaaaaaaatcgagtttgaatattattcatgactaggtattttatttctgaaatacaactatgttatgactgaaagtgactggaggactgctttttatctgagagggaggtgaaaagtcatagtatccacttgagatttcatccaaggggtggggaagttatctctgcaaagcaggtttgagctggcaaggtggagtgctctctgctcacaccctgtggaatcccacattttcaacttgatgtttaacagaatgtctctgaaaggataaacaagaaaatgatgacagtttgctcaaggaggggattggctaacaggatatgaagtcttcttaccatatacattcttgaacattttgaatttttaaccatgagaatatattttctatttaaaaaatttacatttaacatgagcaaactctagaaagcagcctctgagatggcccacaaggatccctgcatcctggtatcccaagcccttgtgtgatctactccgcttgagggcgggctgggggtattgaggcttttctaatgaacagaatacagaaggcgtgatagatgggatgtcacttttgtggcttctgtcttgggtgctcgctctctctctctctctggatttctcactcttggggaagccagattctttgtctccaggcagccctgtggagagccccacattaacttggaaatggatcttctgacgctgccaacagccatgtaaggaaacttgaaggtgcctcagctccagcccacagcttgatggcagctcatgagagaccctcagccagaggcccccagctaagccactctggatttctgacccacagaaactgtaagataataaatgtgtgttgttttcagccactaagttttgaagtaatttatttcacaataatggagtactaaaacaaacaaattaagttgcatttagtaaacacaaattgcatgctacccacattcactttttgatttggaaggtgggcttttgaaatcattttcctataagcctaatttagttaagcttccatttctttcatttttactaagacaacaggtttttcttctgacaaaaactgtatgaaaccatcacatgtatttgtgaattgttactttactctcttggtccctttgctgaaagagagacagggacagacagaaaatcctcccatatttcaaaaatatgtcttttttaagttatttaagatggcaataagccaatgaataacgagtggcaagatttttactaaaaataacttgaaaaatgcttcacttcctctttccctctttttattcatctgatgctcagtgtaccgaagaactgtttggtcacgtgacatttcacctgctatactacccagcaaacagaagtttcacaaaatgccaggtgtgagttacagatgctgtggtgagggataaaaagaaatgcttaatatttttaatggcaaagtgataatgaggttcaatcactatgatgacttttgagtttcgtattgctgctaaataagtccattgagttggtaattgattgatttgcacagatgtatctcaatgttgctctaaggaaaatgttccgatatgccatcttggcatgtactatcaccagaaaaaaccactgtgcttaattttaggtccatgcatttaaaaaagaaccagaagaacacatgtaaaggaggccctccccagctctcagtactcttcattgtaagagaataaaactgaaattgcttgtccctaccaagattaccttctaccaagattgtcttcttctaaagactcctgggtacgttttaacaaaagggacactttatgaacagattattttggagggtgaggatttttatttacattatcatctagaaatagtttttaactttttctgaaatgccacttgaggcttgaagcatactctgtactctttatgaataaaaaacaaagcaacaacaatgacaacttctctcttgttggaaaaccatcacaataaaattatgtttgataaatagggaattatgacttatgaaatatgtttagactgattgagtaaatatccaggcaatggagtactatgcagctgtttcctttagggaagtattatagctattaaggagaaataatagaatttgaatatcaccattatgcacccctaaaacataagcaatctaggcagtagtcataaatggctgctaacatctcgaaaagagaaataaccagacatcatgtgccatctgatggaaatccatgaaaccccatatgaatgaaagtcttattaaaaaaaaaaattaacctgagtcgaaataaacctctagatccaaaaaccaatttacaggaaatacagggaacaaaggaacatgttaaacatcactgcagttataaaaatagtaaatatccaaattatggggaactatagtagaaatgacctgattttctccaacaaataaatgcaagggaatgggaaaaggaaaacctgtagattaaaagaaagatacttaagattcaaataacccagatgtaaaagttttggaaatagtggtgatggttgcacaaaattctgaatataattaataccaccaacttgtatgttaaaattacaaattttatatattttttactaaaataaaattttttgaattcaaatcacccaatataatcatgaaacttatttaaatcctttttcaaatacattgtaaaaaatgaaacaattagggaaatctgaacacaatttgggatattcaatgatattaaaaattactgttatttgttaaaaatatagtattgtgagcttttttaaaagacttcttattttttaaaaatatatactgaaatatgtacagataaaatgatatatggtatctgggattagatttgatcctgcctccaacctaataaattatcctgctattattttatggagactggcagaacacatgagcctcttgggtcagagacaaagaactttattactcatgacacagtagcagcatgaacatcagcatatgtgtattggttccttttgcccctaggtgctacaagagcaatacagaggggcccagaggctacctgcccatacagtaggtttgcttcacagctgaggatcacaacttggggaaacgaccaattttatagcaagcagtaagcaagcctgctctttgttcaggggtgatgatgggtgtggaaggaaggattacccattttttaaggttaccagctacataatcaaccttgagaaatggttctggtaaaagaatagttagagccttgcagtctcttggtccacccagcaagatgtatagaaacaagagtcccaaaaaagagtatttctcccagtaatatcatgacaaggatttgcttccaaaaatctgttgagtgggtagggtgtaggtagatcactgggactatgggtgaaataagttcagtcatgagttgatacttattgaagctgggttttgactacatgaggttcactattctattcactctacttttgtatatatttgaggttttccataataaaagttttaaaaaatctgtttactaaacagccaacatatagctataagagttatagaataagtgtggataccaatgtttaaaaaagagtatagggctgggcgtggtggcttacgcctgtaatcccagctactcaggaggctgaggcaggagaatcacttgaacctgggaggtggaggttgcagtgagccaagattgtgccactgcactccagcctgggcaacagagcaagactctgtctcaaaaaaaaaaaaaaacactatatttttaaatacatgaaattttttaaattccattaaattgtttccattagttatttaaaatatatggaatattttactctgcccactaacactaaaaatgtattatacttcaagcaaatgcagtttctcattatggtaaatatgtacactgttattttattacagatatatgaaagatctgttttatagagcgttgcagtcaatttgctgtacttatccagcatatcctctggaaagggaatcctctacataaatcaacacaaggtccaaggtctccgatatgtctgataatagccacaggatgtcattgtgcaggtgtgagaaactcatctcctgagtaaaggaaatagtttacttgaacatcattgaatgccattttgaaaaaatatggatgcttttagattttttaactacatatacttttttttttgagacagagtctcgctctgtcactacatatacattttaaactacgtttctaaaatagtttaccttcctctttggctcatttcctaagaggtgactttattttgctagctgggattacaaaaagtttattaaactgattgttgaattaaatagctatttgtttcatagtgctagaagttattctcatcaaacaaaacaaaagcataaaacacttggttactgtaaaaaaaaaaatcttaccactttttaatatacaggcatacctcagagatatctgagattcagttccagaccactgcaataaaggaattttctggtttcccagtgcatataacagttatgtttacactataccatagtttaagtgtacaatagtattatgtctcttgaaatgtacttaccttaatttaaaaacatcttattgcttaagaaaaagctaacaaagtgagcacatgctgttgggaaaacaacgccaatagatttactcaactcagggttcccacaaaccttccatttgtaaaacatgccatatctgcaaagcacagtaaaatgaggtatgtcgatactttagcccttagtccttggtaagagaggagagacacactataatttataattcttctaattattttcaaactattttggagaaacatcatggggatactaacttttttacagtataaaagtaagttaatcattctgtagttcctggactaatcctcctctttttttaaattcatatgctgctttatttccataaggatacactgaaacattagacgataacagctaatgacagaatgtagaaatgagacatcagcttctctaaccactcctacaagaatgttagtacacatagtcattacatgtttacttttgatattgtctcattatatcataaaataatgtagaatacagtaagtaggtgatcctgtatttcaggtaagtggtaggtggaaatccgcatttcctcttgaggaaaattcctaggaatcgctataggagggactttgcagccctcattaacacatggacaaagagcagacaactgcgttacaagggattcaactcaccactgctctgtactgtcatatccatgttgatgacagtcctggcacctgctcaactccccctatagagttttgcagttacttccataggatgaatttcaacactacaggaacatctgaaagggctagaatattttcatgcaggccaggcatggcggctcacgcctgtaatgccaacattttgggaggcctaggtgggtggatcacctgaggtcaggagttcaagaccagcctgaccaatatgttgaaaccccatctctactaaaaattcaaaaattaactgggtgtggtggcgcatgcctgtagtcccagctactcaggaggctgagacaggagtattgcttgaacctgggaggcgaaggttgcagtgagctgagaatgcgccactgcactgcagcctgggcgacagagcaaggctccgtctcaaaaaataataataataataaaataaaataaatagaatattttcatggatgtttccaaacctataaactattttgctatcaattaaaacaaaaatattcctaattaaaaacaataaaaaggacatcagggttggttttgttaagtttccagaagtatttgctgtgacaatgttcctctgaaacaggctcgttttctcagatctgcctacacttcccaaatcacctgcatgttccatgctttaaggtaggaacactcagaaaacatgccacatggggaaatcaaacattagtatggggaaaggtcagtttagaattacagctaagttcaaatgttaattttctggaagtgcatattagtcatttgaaagcacaaaataacagaaggaaggtcagagttttgatgaggaagttaaatcatgcacgtcagtaagttcttttcctgctcacagaagagggtgagcagcgagttgaagcagccactacaactcttgcatgtcgcgtgactacacggtaggtcccagctgagccgcaagaggcatctcagtgggggctttatctcatatgcttcttgcttacatcactaagtggctaaatgactagcacttttctgctctgtgagaaacatgcagaagagtcaatctacttaaattttcgtttttcagttgcagctggacagaaattcactttgctgcagggttgctttttgctaaatcctaatatgatcactgtgtgcccttatttgagtaatactgtaaaacgggagaaaagacaggagacctttaaagaggggaaagaccactcttccccattgatggtatagggcagagagtaaggacacaaagagcaaaattcaaattccattttacagggcaggagcccctgtcagtttacaactttttggcacagtcagggcaatatacttgctcctcgtggaaaacaaagtgcttgttggccagattcacagagcattttttgcagtggaagcagcagtcgtgccaggattgtccttcataggccaccacactggagcctttaccaaacccagtgatggggtgcttgcatccagcacacttcttggccacaaagttcttgtagcaatccacacagtattactggtcctccacagtggtgaaatgctgcacagccagcttcttagagcaggtaacacatacaaagccctcggcatgccagggctcatcctagtaagtgactccccaagatgcgatggccttgttgcacttcacacaatgcttagcaaacttggtctcatggcaagtcacacagtagaagtccttccctttagagaagaagcttccagtccccatgacttgcttgcagttgctacaggtgaagcggtctttgtgcgagatggtccccttgtactccatttttgatctcctgccacaaaggccttgaagcaccccttacacttgggagagtcctcctgagtggcaaacttgttgcacaggatcttgttgtccttggccacaaaggtctcattggcaaggggtgaaggcacttggcacagtggaagcaggggtcatgccaggagcagtttttatagtgcacctccttggagtccacatggatgggcttgcagcattccacgcaggtgttggcacagaacctgtcaaagcatttcaggcagcagtggtggtcacccttctgcacatactttttcctctgcaaggggtccctgcagtagagacagtcaaaaacttctctgccatggtgcccaccttatagctggagggacctcactttggatgtgtgacaaacaggatgtatttggcaagggctggatatggttgaaaacaacttccaacgtgctgcctggggatgctcacccgcacagctggcggtggcggaggtggcagtggctgcagactgcctcctcttttaatatatgcattgtattcattctcttttgaagtattccacagattctcagaatcagttcttcattacgagctgttcaacaattcattcactcagtagatatttaccaagaatctatgtgccaggcctggtgctacaggctaaggataaaaagggaacaccacaggcgctaccttggcagagcttatgatccagtagatttgttgattagagcgtttattataagcaggtatattcgtgtgtgtgtgtgtgtgtgtgtgtgtgtgtgtgtgtgtatttagctaactcaagttggaggagaaaggggtaaatactagatgacactcaagtcttttatcagcccattccctgtaagtcccctctcaacattctaagttctttgtcatctgaaaagtattcagcaatctcagatgtccttctttttgtgctcctttttggggaatagctaggtttccacacatttttttccccacaggtgtactcctacatagagaaatagcctatttcactgcagaaagggtgagaaagttccaaaaaaggtaataaaccagctgttaacagaacctaaaaaccccacttcttaactgtacatctttctgtctgcctcctaagagtatgcctttgcctttggaaacacaaaaagaaagagagtacgtctcccttctggggatcagcaaccactgcggatgctcctgcactggaggcctccgtgctcataaccattatgggtcctgccattgaactgttcttacagaaagtgctcttcactgggtaccttgaaccaatgtcaaaaccaagcctgtgccactaatgtgtgacactgggggctgtgggctacaaggggcccatgtatctgtgtcaggagagagaggccccatgcaaagcaaaatgtataatgaagtctgtttaacgcaaaagctacctaggaaaattctctctggagcaaacgcccagaattccatctgcagcctgactaaaagtacctaggagagagagttgtgaaagaggaaggagaacaaagaagaaggagaatcaagggagctgtgaccctaacttatggtccagcttctatcacctgtgacaacaaagctaggaaaactatgctacctactaccctaagacatccatcttttaaactgagtccaaccaccaacatgaaaaacaatactgactcacccctccacccatatcgtccattctggaccagaccttctaccttggctcacaggaaaagaggaaagtgttgatgtgtgccaagtggaggagaagggactgtgctttggactccctctttctagtcacaccaccagggaagatgcgtgccctcaggagaccacctggcagatagtcacccatttggctcctggtccctccccctttccagccactttctcctgctgaacccatcttgcagttcatctcaattagggctctgagttctgtctttcccagacaagcaaactcaccctaaagagtttcgtccaacgggaccatcattcaattcttgcaagtctcactagtctcactctgtggagggctatttctccctgtcgtaatgaccagcttgacagtggatgtatcttcatcccatgtcctgcttcttgactccgaatcccttaggccatcatattctaaattcagagtacctcacctcctaagcatttcctgtaacagtaagatatccatactttaagttattcaattttcctatagtaatcatctcaaccagtctcctactcactgccccaaggtctctaagaatttatgcaaatgacactgggggacaaggtcataatctcccctttcctcaagggcacaggcctcttcagacacacactaggatatgctgtctatgagctatatttataatatggcattgacatagcctttctcttgcatctgcactccatcctgctgcttctctggacttatctcaatcctcaaattctctgttttaagcctaagtctttactccacactgttgcaaagctatttcgttaatttaactggacacatcacacaatatctaccattagccttgtgttataaatcagaagcctgtttatcttctaaggtagactctgtcattagctgctttggatcatagactaaaaataacattcaactgctctctgaaccctgcaaagtgtaaaaactagaaatgtctttttttatatgggccaggctgataacttgctaaaatgtcaacctgttctttgacatttgtgtgagtaatccaacaggttctgtgcaggaagcacagtatttgctagagttatttcaagtacagtacagcactttgctttgataatagaactcagctgcagtcttctttcacctgtaaaacagagattacaagtgtttacagaaagcgctatttgacaaataataaatgagaacagtttcctgatattttcaggacttcaatcaccatcctgtagtacagcaacattttcttttcagacacatatttaggtccccaaacactgaataaatagaaatagcttccttccaaacagcagaaggaaagtgtgtgtgtgtttttttgttttgtgtgtgtgtggttttttgtttttttttacacagagtctcactctgtcacccaggctggagtgcagtggcgctcactgcaagctccacctcccaggctcaagaaatcctcccacctcccacctcagcctcaaaagtagctgggaccacaggtatgcaccaccatggcccagctaattttttcatttttttgtggagaaggggtttccccatgttacccaggctggtctcaaaaccctgggctcaagtaatcctctcgccttggcctcccaaagttctgggattataggcatgagcccactgcacccagtcaagaacttttattcatggtagttttttcttatgaattaggtggtgatcgagtggttaattgttaatgagattggagttactgtcatagcctaacaatggacttagaatcctttaatattgagcttttcctaaatgatcagcttagctgtttgtgttaacaccagtggtttgtcaccaaaaccactcatttaattgagaaagcaaataaataaatattcacagcacagggatctgaatgcatcagccaacatctgattgtataagtcatacagacatgagagggtttatcagcaaatccaaaagacaattctaaataggactaaaaggcaacatttttagtcctgggagtgtaagtcatggggaaaatgtcttaattccaggatttatgactgttctcataccagaggcatttaaaaaaatcattatttaccagcctttatttatacccaccaactcttcaggcaaacaacatccacattaggtattctaagtactgcttcccttacagagaattttgcaaagtgaatggtctaatcaggttacttcttatgattactgtcactgaaatactgaaatcataaattaggactttgtttttaagaattaggataatggataagaataagagcttttttctgcttagcagtctagggaaaaaacgcaaataaatttttttcttttttttttttttttttttgagagggagtcccgctctgtccccccaggctggagtgcagtagtgcgatctcggctcactgcaagctctgcctcctgggttcatgccattctcctgcctcagcctcccaagtagctgggactacaagcgcccgccaacacgcctggctaatttttgtatttttagtagagacggggtttcaccgtgttagccaggatggtctcaatctcctgacctcgtgatctgcccgtctcggcctcccagagtgctgggattacaggcgtgacccaccatgcccggcccaaaaaacacaaataaatatttttttaagaaaaaaagaataagagcttttttaaaaaaaaaaaaaaccctacatttgttagtatatgaaaaaagtgactaaatctgggtggatgctatgaaatgcaataatttgtgtgaaaattcactttccatgaacattaaaatcttttctttaaaaacggtagtttgttttagttatctttgtttctttggatggtgtattaattaggatgttctagaatgcaaatgacaaaatccaattcaaactgacttaaatcataaaggaaacatattggacctagtaattaaaaagtctagatgtctggcttcaggcaagagttaatctagtgattcaaatgctgtcaccaaggatccagttttctctttgtgctgccttcctttgacttcatcttcaggttctatagaagtagcttccaagcagcttgaggtccttctctcaggatggtaaaatgcccagtgcagtccagacctaacattctcaagtcacacagtagaaaggaagaacatgtctcttctaatagattcaaagtcctgggagtcactctgtctcattgactcctttgactcttgtgcccaataactgtggccaagagagctgaatacatggattggtccacccctgaagcctgaatctttaaaatctttttagctgcgtaatcttgtttttctttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaatttttttgtatttttagtagagacggggtttcaccttgttagccaggaaggtctcgatctcctgacctcatgatccacccgcctcggcctcccaaagtgttgtttttcatttataatatctcattataccctttttggttgttatccccttgagatgagcaactataacttctaaattccttgcactatttcaaagtgctcaaaacaatgaatgctcaacaagtgggattgagtgatctaataatttaaggtaatcactctgttgtaatgatcattacagtcattctttatcaactgttttttagtataccagggtactttgcaaaaaacggtcacgtaccacttaatgatattttggtcaatgacagactgcatgagacgttagtctcataaaactataatactgtacttttactgtcccttttctgtgtttagatacacaaatactgctgttacaactgcctacaatatttagttcagtaacatattatacaggtttatgacctaggagcaacaggctgtagcacacagcctaagtgtgtagtagaccacaccatctaggtttgtgtaagtatactatggtgtgcacataatgacgaagtcacccaagaaggcatttctcaacatccctgttgttaagcaatgcatgagtctattagtatcacaggatgatgaatgttctccatggcccctccagatcctctcttcaccctctccatcatgctcagtgcccaagaggctgacttcaatagactgttcaaatggctcccttccctctaacttccactcaaggtcagccaatggaaccaccaagaggagtctgaggagtgcaaggaaacaggagagggagtgttgatttcttggtccccttcctgctttcccgggctgctttcctcatggaggccacagctcctgtcaagtaaccctctcctgaagctacagctacatctcttcccaagttgtagattctgggaaaccagtttttccctttgtcctttcaggcctaaggatgagaaggctccctgatattgatagttctcattggtttctcttaatccctacatctgtgtgtgtggtccttcactatctcctcagttacgttatttcagtgtgccatttgtgtactgccaggatcttgacacactattacaaaacccaattcaaactggcctaaatcataagtggaatttattgaatgatgtaaccaaaaaatacagacatctggtttcaggcctcccaaggatctaatcatctcccaaaggtcccacctttaaataccatcctcttggaggttaagtttcaacatacgaattttgaagggacaaatacatttaaatcataacatgtcttcgtcaattttttaaattaaaaataagtttttttaattcttttttttgaaacatagtctcgctctgtcgcccaggctggagtgcagtggcgcgatctcggctcactgcaagctccacctcccgggttcacgccattctcctcctgcctcagcctcccgagtagctgggactacagacgcccgccaccacgcctggctaattttttgtattttttgtagagatggcgtttcaccgtgttagccaggatggtttcgatctcctgacctcaagatccgcccacctcggcctcccaaagtgctgggattacaggcgtgagccaccgcgcccggcgaagtttttaaattctaaaagcaatgaatgttcattatacagaatgtagacatttaagattaacaacaacaaaaaaaaggagatgggaaagagtagcctttaattccactgtggtaagtattttggtgtatatccaatgctcaatcattcctctctctccccctctgggatcttactgtaaatattcttttaagtatctttgcatctcagaacctaacacaggttctacttgcatgagtaaatgatatttaggaaaaagatcaatgcttgaatgtccaaaccagctcttttgtcacatgctgctaaagataatatagcaactgctacaccattctgttcccatgtgcctgccaaaggaataccatgtcaaggacttatctgaaccatcaagaaaccacaatactgtactaagttcaagggaatgctccttaaaaggagagggactttacaagcccattggcagggcttcacaagtgaaggagcccttcacttggagctaccagatctagatttaaatttcaactgggtcattctactcattttacttgtttaatcctccattttctaatctgtgagatgaagacatcaacttatgacctataagatccctagcagttaatggtctatgacatatatctctatctatccaaacacaaacatacgtgtgtgcgtgtatgtgtatgtgtgtgtttgtggtgtgtgtgagtgtgtgtgtaagaatgaaaaaaagcaagaactatgccttaggtgctagtatgacaaaatctgagtttgtttgcttgttttctaaaaagcgaagtcttataggtaatccagccaatatgtttttcatgcctacactttctgtggctaagttaggaaaaccgaaagcaggaaactcaacaaagtacgacaaaaaaataactggaaaacactcctctgtgtgtgtgtggcttttattagctctcagtgagattctcaaatgactgttgtaattctgtctgaagttccccttcttgtttcatggcttaatgctttgttgtgtcatttctgaaacactcccccatttccaacgttacaagcagagaacagctcttcactcacttgtgaacaagaagtgttgtaagagaacttaacaaatgaagcaaaagaaatcataatatcaaagcaggttaagaaaggaaaatgagaagtgtctggaggaaagggagcatgaactatcaccgcctaccttccttccatcaagctcagagacgtttttaaacctcacaccaattctttgacagcttttaagaaatgagatgcttccattttgatctgagttatgctgaggtgcctcttcgctctgcctaagcagaaggtaggttaagcttggtagaggtgaaccacagggagccatgcttggaaaactctgctcctgggaagtttatccattcaagtgcaccaaggctttagaactccctacccctagaatgtctgctttttccaaataatcagaacacatttgtttattcccagtacgggtgatgtgtacccaattcttatccatttcctccagcttgggacattttgccactatgcaagtaccagggctggctgcaagtgttgtcttttacgcctcaggtccagaccagtcctgctgtcccagctttcaatgttatggccaccaaatgggtgtgtggccctcctgttcctgtagtcagtggagactggggagtaatttctgcttccaccttggctggcacaggagtcctctcatcttcagccactgtggctgctgctcttgcgtcgaatttttgtggtttttttaatttaaattttatagttaaaaaaattagagcatatggtcacatggctcaagaagatatactgtgaaaaatttctcttctgactttgtcctcctgccactaaatcccctcctgcaacaagcaaaaatgtacatatattctttttaacctctttttttattgcaaatgttaacatactacattggaaatttttcacctaaaatacctagagattatttcacaacagtacttaaagagcttcctcactgttttaaaatgttgtatgacatctcatcatgtatgactatcatgatttatttaaccagtctcatttagccagctgatagactttttcaggctctttccaaactttttattatgtatggcatatacaatttcatatcggtacaggcatatctgtaggacacattcttgcaagtggaattctgggccaaggtgcttatgtaattaaaattttcacagatgctgcaaaattgcattgtctggaggttgcacccatttacactcttccagcaatatgagtgactcacactcatactgggcttcagtttacttatgtaggaacttaacctgctcgaagtcactccagcctaatggtctcccaatttaaaattgtttaacataatattaatgcctaagcctcaatagtaccccccctcctacttgctcaactgcatgtaagagatccagttttttattattattataatgaacagaaatttattggctcacagttctgggggctgggaagtccaaggccaaagggctgtcatctggcaagggcctttttctgagagatccaatgtttaatagtgtccctatttctataaatttgctatagacttcagggatattacatgtgcctatgagcccgtcattgtcattatttcccattctggtgagctgaacacatcctctgtggcaggtggttccatagaagcatcactcagaactgaaacaactcctgagcccatggctatccctgggtcctggtggagtggaaactcaacaatgcctagagctacatctagtgtcaatgagctacagtcctgcagctgtgctggtaaagctggaactgaaatgtccttgagactacagatccaaacagttgaccttacaaagtgaaaaggacaataccccatctgggtgacactcaggtgcagcagtacagggtcccacagtaaggttgtgtggatctaatgtattagaccatttactctcacagttcctttaattaatacgctaaacaacttttgccaaggatcatacctactgctagaagtctgtgttgaggtaaattctacagcaataatctaaaatctccaccccatctgaagcccatgctctatttctgggtctaactttccaggctgggctccttcttctcttacagggtgctccttcctcttatgtcccacactgttctttccaaaactcgtgccctcatgaggaccacactagtccatcagaccatgttttatatgctttcacagagtttcaagtctttttcttggaaagctgtgcacccctggcataaatcggtggatgccaacagaaccatggtagatggatgtacaaaggtcaccatgttgactctcactcacaaatcgcatctaactgatactctctagaggatcaggtcaaattgataataagtaaatgagtaaataaactcttccctacagtagtatcacaataaatgtagaaggaatgacagaaatagaaaatcacaatttggtaaacaccacagtaataaatatgtcaggcagagataattaatggatactaaaattaatagacaaaagtatgatgaaaaacagaatacttacatagtttcaaagtatcccctcataagatgcatattaatttcaaaggaaagaacagtaactttacagcagtgaaacctgccagatcccatcttaactaagtgatcaaagtgcctcattaccaatgacaagacacatcaactactttcctcctgacaagacacactgagaagggtacaatgtcacttctatgatattcttgacaaaacgtataacctgaattaaatcattgggaaataacagacaaacataaattgaagaacattctgcaaaataattggccagtactcttcaaagagtcaaagttatgaaagagaaaaactgaggaactgtcccagattaaaggagaccaaggaaccatgaaaactaaatgcaactggtgagcttggactggatcctgaacagaaaaagtccactaatgggacaactgacaaaatctgaataaggtctgtagattacttagtaatactaagttcatttcctgtttcaaaaatggtactatagttacataatataatatttgtagaagctaggtaaaaagtatgtgaaaattcttcatattagtttttgcaactttctcaataagtctaaaagcatttcaaaaggacaagttgggaataataaaaataaattttaaaaactaagacagcaaaattcacttattacaatattggtttgtagagagtgtaaagatacatattaattacaaaaattatattcatgcttgaatttaaaactggacaagtaaacttatcctttgattagtcaaatgttggcttattcaggcatttcttaaaagcactctctaaaatttcagcatttattttattatcagaagttgaaggtcagtataacaattgtatgtgaaaatatttcagtaatcctggtttgcccttgcaataatctgaagacatctctgctggggactattttattatgacaatcgagcactaaatacactgaccttcagattgtcagttactgggtgaaaatggatagaagattttccatttggcagatgaaaaatcaagacccccaaatccctttccttaggaggtacagcttaggcaagaaacctattatattttttgctgtttgcctaaaatatagcaatataccactttaaatgtagtgatttcatttaccaggggaaggaaaaaaactgtataacctagaggcaatatgtagaataaaaaaaaatgatagaataattggagccacaggaagcggaacatttcttacatgacacggaagattataaagtgttatcgtttagtagtttcttatataaatactcaaggaaaaataattgaataactagtagccttaatttaggggtggacccataattactacttataacaacctctgccaaattatttaaatatttacctaaaaggtaaaatatccagtctgtaaggtttgctggcctattgttcttttcatttcagagacatccacattattaaacatcagctggacaacagcacatgagtacaagagttgtcagaaaatcatctgaggccagtgtaagaaggaataggtttgaggattttttcccaatcggcaagtgaggtccaggtctggaagtcttagtttccttggccctcataacttccctggattctgtgctgagtcttccttcttgacctttgccatcccactcccctttccatcttctttttttattttcaagacaggatctctctatcatccaggctggagtgcactggcatgatcatagcttgaactcctaggctcaaccaagatcctcccacttcaacctcccaagtagctgggattacaggcatgaaccatcatgcctgtccatcttaatagatgggcttgcacaagaaacaaagtctgggtatactaacaacttatgaggtttagctgcctttacttgcccaagaggttttcattttggagatttagctttgccaaaccctatacttcctctcaaattgctggattggagataggttgagagagtggatgtttacatgtctctgttctcaggtaagtctacacttacaagaaactgggcaaatgactgattcccagaatctctcttcttgcacagggaagggcttcctcaaccaaatctagggaagcttcttgtcaaattggttgtctctaaattccacagaggactatatagaaaatagagtctttgggatatgatgaagacctctcagtagaattttgtctgcctcataaatatctttccctcacttactaaagctccagaggacaaagattatgccattttcatcatttattattcactccatcaacaatttatttactctgagccagaccctggactagacattgagaacagaaaactaaaacatagtacctgcccttgaaaggttcacagtctggcagaaagaaaaacaacttatgatgtcaattatatgtactatagcagtgatttttacaaaatgttgtaggagcccagaaaaagggtcaattgagtttgctgaagaaataattcagagaagcttccactgtgggggtaacatgttacctgacccttgaaggataggccaggtgggaaggagaagaaaaaaaaaaaaaaagaagaagaagaaaacacgtaggtgtggaagcataaatggtgaggtagaggagtgacgggagaagagtggtctcacagttgttctttaggaaggtgaaaaggtaggagtgaagtggttaccttaagaaagaagacagtgatattagatatggtcaactggcacacagcaaaagatggaaagctagtcttcatttcccagactccctcaactagagttccagttctaattagatgcactggtagaatatcagaaggacaaatgtgacaaggaggccatcttcctgctgctgctgcccagcaaggtcatggagatggtttttctacagcatcactctagcatgcagtcttgatctttgtgagagtaggaggcaacagcagcagtgctggcaagaactttctgatcctggcttcctggcaattggatcacagctctcctagtagtctactgaacacagtgttgtcacagtggcctcctggctccccaaaggtagaggttcccccggctggttagtcctgtagggtctggcagttattcaggcaggaccaacatggcacatggtccttcacactttcaatgattttggaagcatttaattctcctaattaagtatctttctaactaaaaaactacattaatttcccttttgcattgaaccttgacgaagcaaatgtaaggggaaaccatgagaactccatatgtgaatgagaatgatactgctaccttttctgttcaaaatggcaaaataattaccattttaattaagaagatgaagtgattatttttatatattcttagtctagtattagcaagttaaaatttgttacactttttcaaaacagtatttgtgtttgtttttctatatacttactgtcttatttatgccatttttttttcttaagagacgaagttttgctttgtcccccaggctggagtgcagcgacacaaacacagctcactgcagcctcgaactcctggggtcaaacaatcctcccacctcagcctccctgtagctgggactacaggcacatgccaccatgcctggctaaatttatgccatttcttgagtagaagtatcaacttattttaaaatattaatttgcctcttaaataatattagattcattgcattttatattagagctattttatattaaatttattttttctttgtgataacattaaatcactaacattattaactacatattctaaactgcttttatacaaacgacatcaaaaaaaggtctgttatttgctctagttccctagaattttctctttgattttgtcacatatatatgtttaacatataaaatggacccagagaaagtattatttagaacaaaaaactaaacctatcagctcccagtttgcataagtctgatcaataggaatacatttctatattattcccttccacttgctgagatggaagttcccaggaaactgaattttttcaagttcctacctattcatcagtcctccagagagagagatctagattggagaatgctttgtttagcacaacatggtaatgaatttcttaatttacaaaaacatgtccaaaggaatccaatagagagtaaagagcccaatttgtctactgtataaagcaaggaaaattctgaatttcagagacaaccctagggagaagtgacagagcccaggggcaaagagaagagattcagaagggtgggaagtattctagagtgagtgaagaaaagtaggcaggtagtcaggagcagtgggaaaggacatgaggagggcctacagggatggccagggaactcctagatatcaatacctaatactccttatttaagttgtgggctctatgttatggattaaagcatataaagagataggaaagccattagcattctaacattggaaggaagagtggaagaggagaacccagcaagaaagattgagaagaaaggattagagaggtgggatgaaaagcagaagtctgtgagacatcctggagggtggtgggaggcaagtgatccctcaggttcttggacttaaataccatctatgcactgataactctgtaggggaagaaaaacatttccctatcctgttaggttctgtacctgaggcctatgcattaaactgacaaaagacagattaacagaagaaaagtgtaccaattttatttgatgttaatatttttaccattcatgagggcttcatggaaaagaagtgaaaaatcaaagaagtggttagacttcggggcttatatgccatcttaacaaagggtgataaattgaagagaagtaactagataaagaaaagggggtttgggtttatacaggtggtaaactgtgagaaggtaaaaatataggggaaactaatggtagataaggattatagtaaggtttctttgtgcagactcatcttggtgctgtctccacttctggtggtaagggttgttttccttgtctcggtatgggagaagaatggggacacctttgtgagaatttatgctcttttaggcagataaggacagagagctcttgctgtgtctgattttctcatttgccttcaggtcaaaattatccttatgccaaagtggcatatttgggggggcaacatattctgattccattcaactcccaaatttatacctccagccaagacttctccctgaaatctgcttctcatataggtggctgtgcaatccatatttcctcttggatgtccattaggcttcttcacattaacacaccaaaaactaaatttctatattttcatgccaaacttctttcactcttatatttctcattttagtaagttacaattccattcttctggttggtcaaaccaaaaatcttgaagttatccttgattcctctctttccctcatattcagaatctcattgactctaccttcaaaatataaccagaatccaagatgtcccactgcctctgtagcaaacacccaagtctaagccaccatcatctctcacctgtttgctgcaataacctatgtccccacttctatccctgtatctcctctcacagtctattcacaacacagcaatcacggtcctttctaaacagaagccattttatgtcattcttctaaccctaatccatcgtggcacaccctctgaagccctcattttactcagagtgaaagccaaagtcattaaatggcctacacaatctagccccatttccctctgatcttatcacctactcctcttcctctattgaatctgctttagccactgacctccatactattactcaaacacacctgcactctcccacctctgaacttttgtaaatgctgttcactctaccttaagtatggtttcctaggacacccactggccttgctccttcttcttcttcatgccgtttttggtcaaagtggatctcctcaaagaggactgccctgaccatttaagttccaattacatcctccttcccactgcaagcagtccctttaccctgctttgtttctattgtaaggcttttaacatacagtgggccctccctatccaagggtccacatctgctgattcaaccaattgaaaatacttgggaaagaaaattaacagaaaataacaataccacaataaaaataatacaaattttaaagttacatagtataaaaactatttacatagcatttacattgtactaggtactataagtaatctagagatgatataaagtatatgggagaatgtgcataggttatatgcaaatactgtatcactttttatgaggaacttaagcatctgcagatttaagcatctaaaatctagaactaatcctgatttactcactgtcattcactgttacagatttttgacaggggtcctgcaattaatccccagccaatactgatggacgactgtaccatataatttgccttcttgtgttttacagtctgttctcttcttcccaaaatataagctccacaagagcaggatgtttgcctcttgaacactagtatatcctcagtgtctagaacaaggactggcacataataagccctcaataaacatttgtttaatgaatgaataaatataactcatttcctcaaaaatctccagtaaagtctcttgtaactaatagttttgctttggcaaaagaaagaacaggggccaggtgcagtggctcatgcctgtagtcacagcactttgagaagctaaggcaggcagactgcttgagcccaggagttagaaaccagcctgggcaacatggagaaacctgtctttacaaaaaattaaaaaatttagttgggtgtggtggcacgacctgtggtcccagctattcaggaggctgaggtgggagaatcccttgagcccaggaggcggaggttgcagtgagccgagatcgcaccactgcactcctacctaggcgacagagcaagaccctgtcttcaacaacaacaacaataacaaaaaatactcctcgtttgggagagaaataactgtcaaataataagagtaaaattggaaattcaaaagtaagttggaactagaagtggctaggggaaactccttactgccaccatcaataatatagatggtgtgctgggaaaaggatttgagctatttttatataaatatttttatataaatattaaatggaaaggagacccagaaatttgacccataaatctgaggttatatgtgtgaacattagccatcattcatgctgctacacacaacagggagtcatggaaggaagaaggtctggagtgtaaagagcatagaagtgaggagaacaattaaaaggccattgcaatactagttcacgtaggtgatgataaggacttgaacaaggcaatggtaatgggaatgataagggagggaagaattccaaatatctcagctgtagaatcaacaggattggtgactgactggcagaaaggcatggttgggatgcatccaaggtttctagcatgagtaattgagtgaacaacgatgtagttattagatttttacagtaaaaggggcaggttttgctggggaaatggtgatttttagttggacatccagtggaaacatccagaagaaatctggaattaaacatgaatgcagtattttggaattaatctgtaaacagaatgcacaaatagaagagacaagaggaaggtgaacatataaaaacggtggccaggaacatgtgagaattgggtaaaaggagagaagtcaacgagaaatcagaaagaagttgatatacatgccaaagaaggaaaagaagtcaagaagaacagtcaatattgtcaaatactgagtaagatgccagctgagagaaggtattgggtttgacaaaataattgttactggatggtggaggtagaaaccaaattgttgtaatctaaggagtgaatgacagaacaagaggacactaaattaaagctctgctgatgaagaaaatagtaaggcagtaacttgaggatgagtcattgtctataaaggatttttattccccaccatagtcctaacctaacatttgacatctatctagtaggcactcaatacctactgaatgcaataatattttcatttatagaccaggtctcctataaaatagtccagtgtttatgtccacataaaacagcacaaaacagattcatcattctgggtgggtagagggattgaaggaaataaagacatttcatattctatattatgttttgggttaattggcaagaataattacttctttctcaccccatccctgactatacacacacccaaattatagattatagaggagaaaggaattaaatgactcctgagaccagaactgcatagtccaaaaaaaaaaaaaaaattcagcaatcttactttattaaaaaattaggcatcaagatgctgcaatttgccttacttacatatttaattgctcttaggttagatatataatatgggaaacctggaaaaaaattttaatggtataataaacgcttacaacctaacattaagtgaaaaaagcagctgccttattgcatatgatctcaatttgggaaacaggaaaaaatataaatacaaacacacatgcacacacacacacaaagtcagaatactataagaaaataaactgaacggtcacagtggctcacgcctgtagttccagttactcaggagacagagacaggtggatcgttttgagcccaggagttcaagacccgcccgggcaacataaggaaactccatctccacacaaaaaaagtaaaaattagccaggtgtggtggctcatgcctgtagttccagctactcaggaggctgaggagggagatcagttgagacgaggagttcggtgatgcagtgagccgagactgcgccactgcactccagcttgggcaatatagagcgaaactcagcatcaaaaaaaaaagaacatctttctattctgaattttcccaattttctacaattaaaaacgctttaaagatctctataaagtcagtcaagggaatttctatctaagcacttaccagcaatttgagctccttctcttttggtctaggtggctctaaaataacaataaaggctacagtgattgaaattcaccagacttgaaatagactgcagccttcttccttcccaccttcttagaatctttgtcctattcatcttccttacgcttccccgggttctcttacttctggattctaacagtgagttgtgagaagcaacgcggaaaacggaatggagactccagcttgttttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcggagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggtagcaaagccgagctctgggcagggggcttcggcgcgctggatagtggaaggggcggggaaagccccctaaaagggcgagcgaaagcaagggcgaggtggggtggggtggggtggggttccgccgcgaggcagctggctgcaggctgcgcgttgtgaggggcctgagggggggcggtgttggcgacggcggagacagagacggaggtggtggtggagcagcaggggaaggaaggaggcgccgcgctcagaatccggctgcggaggcgcggctgtgggcctggagttcctgtggtcgcgctgtcccgggcctgagctggaaggtcagcctcccctggggcgcagacgctgacccttcccggggctcctcccctcccttcaccccatcctctggccttagctggcctgaaattaaggccacggtaataggggtagcaggaggcggcggactgacctaaagcagctggttctttgtgcgcatagaccgtaagggggaatgatctggacttggtcagctgcctcggggcctaggcagggatctgctcatccagatgttcagttgcgttgcccttctttcccttcaatattattaacttaatagtccacttgaagcttgccggcttttttccgggcgacgtggtgtaaacaaccacaacctcgttggtgctgcaacgagctggtggagcccagaaacctttcacatgccagtgtgtcatcctcgtagtaacgtacataacatctccccctaattccacatgcgtgtcatttgtgcatttcttccttgcgattttccctggttcttgttctttgccaagaggattaattatgtagaacatcttggactcaggatatttattagtcgtctcatcagctgatgtgctgagaaaccttcataagccctcaaattgatcacatgtagtaaattgttactataatcataaattgttacattcatcattgcctttctgttccttactatttcattgcttagaatgattttttctttcttccattttatcccttctttttttttttaagtttatcgatttattggcgtacaatacagatgttttgagctatgcaagttaaaattcttctgtaaactttttaagtgctgtgaaaaagacacacatgatcagtaaatttggaattttggaatttggcagaaataaagtagttccgaacagggtgcagaagggaattagaaagaggcagatttcgagttcagacagataagactaggtcttaagatcagtagaagtttctaattatactgttcttaatctttcaagagttagtgttattcctctgacgtgggtatacagtattttattagattgtatattgaaattgtctgtcagatttgtacttacagaactccttagatttacacttgacagtacaattttatgcccttcaatacacattgttttacaattccagttgctctttaatattgttgtaagggctatataattcaccttttgaatagctgctcttatttagttgtgatcttatattaaacagaggctgtggagtaatgtgacagtggcagagagctaaaacttgagccaaactgcctgtttgtaccccacctccaccaattattggctgagtaactttgagcaagttaatttttacctccctgtctgcatcggtaagaaaacatatttacctcaaaaaaaaaaaaagcaagaaaaaagaaaaactttaagattgctgtgaaaataataggtgagtcaacttatttattaaaagttattaaaagtgtttggcacgcagcccctcccttctattctactccttacccaggatgaaggatttagattggattgttattttattttttgttaactactctttgatatgctgaagaaagattaacaaccctctattcagtaaactattaggttgggagttatgtagagtatagctgtttactttctattatttgaggattgattattaaaatctactgggcatactgcaaaattaagtgacatttatttttctgtccttgaaattttctacatggctgtataaaatgtttgtgagagatcttagagtactactttcatgcagcctaacacacttatgaaaatatactagcctagaaagtacctcagttttatcattccagataatcagaaactataatacatcacttgtgataaaaagatcaaatgtaatgaaaagttcagagtttaacttacaaaaaagatcctgttgtagaatttttaggcaaaaggtctgtaataccaactgagtttctgtcatttgttgcttgatgttttatgtttagaaagatggttaatagattcagtgatctttaattatactttgcacattggggagaaatgtttgatacaaacaaataagttcagggttaaaaaaaaaagtagctaatttgctttttctttgtaattcagtataatttcagattctcgtgtcccatcgaagtttctagcaagaggactgttgtcacatttccttcttggactcattactggtcactgaaaaccagaagtgagctacatgtactcatacagtaactacatatagattaacaatgtgctgctgcatagtagaagttgatttacaatcctggtatcaagaaattttagagtttaaaaggatctagtagggtttgtttggaagcctttttcataaattcagtcttaacatgaaagcagagtggtgatcctacagctgactgatctcacccaacaccctcgtttttcagataaactgaggtccagtgaggttttgtgacttaatccaggatcgtcaatcaagatagtaaaaccagatttagaccaggtcttctgattcccaactgaatactctttctgtctcacaatagataaaaaataagttgctttgaaatactttaatcctgacttctttattattgaattatgcaacgtaaagacttaacatgacttgtccttgctaaagagaatcatcccattcagtattctgcttaatgtccagttgagttttgagacatttaaatggctaattcttagaacttttataaccctccattagttatttttgttgcacccatctgtcttcctggcaagcaataaaaccttgacatatcatgggcttatgtgcttaatttcaggacagggaagaaaagagaaaatttgggactatatagccagactatacaggtctaatttctgactctgaatattctgaagagaaagaactcaggaagccagtcctaaatcagaaaactacccctcaaaggcttaatggagggttttgcagtttagcaaacccattgctaaggaaagaatacaatagaagggagttggagctattacagaagggcactgctgttgtctagatactcttgtatagtgttatttgtgtagcacatattgttactaatgattaaggtcccctccagctttcagatcttattgttaaactactatttgcatttttcacaaatattttatactgcttgaaccaagcctttttcttttttgctcagttcatggttgacagatcaactaagctaatttttattggatgtagtaatttttaaaagttcctctgtatcacaaattctgtaagattggtgcctgtgacatacttactcttgatttttttctcaaaaaggttaaatattggctaaaataacttagaaatgtcaaactctatcttattatagtatttgagtgtcggtgtattctaaagtaaaaaacagtatttattaaagaattttataagagtattctaaccaaacttccaatttaaataattttgtattttaagttacagcacccagtgtattggtgttgggtgcaaagaaaggaaaggcagtccagcctaaatttattggctcttagcttcctcattgtaagacagttgtgttcattcattgaactaagaagttctctccatttgtttgaagattgataggttggtttctctttattagtgggtgctactattcccaaaaggccttcactttgttagaagtcttctaggaaaattataaaaatattctgtttacatcaaaagagaacaaagagggggaggtactgtagtccaatgtataaacaaaaagaaggtaaaacttttataccttcttatgctgcatcaggagaacagtgaaagtgaagactgcatgcacgttggatgtggtggcttgtgcttgtaatcccaactatctgttcatgttctcatggtactttttttttttttttttaaagagacaaggtctcactgtggtgcccaggctggaatgcagtgatggcatcatagctcactagagactcaaactcctggtctcaagtgatcctctggccacaacctcccaactagctgggactacaagtgtgtgcaccacctcacctagctaattttttttaattttttgtagagatggagtatcagaaagttacctaggctggtcttaaactcctggtctcatgcgatccacctcggcctcccaaagtggtggggattacagggatgagccactgagccctgcctctcatggtactcttctacagcaatctatctttctggcttcaacgccaaagcaatggcacaaattatattgttgcattgaaggcagtctacaatatggataagttattataagttaataaattgcaatactttaagaaagtatcagtaaacaagttaattctgtgtctagttgggagagattatccaagtccgtgttttctggtctcttcctttcattgcctcttgatagtgcctttacaaaggacagggtgcagttttagaagagtttggtgaacttgaaattaattgttagaatgagatttttaaattttgtgcatacatatcaggttccctattgcgtaatatgtaatcagcttctcaattttttatgtaccctaatatttaatcaggttttacatgtgatgcctctatcagcagtcagtagattagtatatttatgtctgtattcaggaatggtataactgagtgttagtatgagtatatttgtatcatgcctaaatttgatatggtcattctctacaattactttccttccacatttcctttctgttgataaagttggaaatctgacatctttacctagccattttatttatcctttatcattgagttctatgtgttctacatttgaaatgtttcagatatctaaatttctttcccatttatagtccagtatcacactacaatttacttgaatattacagtagtcttccatccatttccctgccttatgcatttttttccagttcatcctacacacagccaccaaaatcatgtctaaatcatttttctagttatgtcctattaagaaactactagtggtctttctgctgcttacagggtaaagtagaaatttccttgcctaccttgatgactattctgcttttacacacttaatctcccagtacttcctagcttgtctctactagagccaaattttgtgtcattctcagccacaatatttatggcttttcagtcagtttacccaaaacttgttcatctttcaaactttatcttcctcttccagtgttcccatccacattgataatctcactcctaatttgggtgctttcactttgttgccaaggctggagtgcagtggcatgatcttggttcactgcagcctcaacctaccagggctcaggtggtcttcctacctcagcctcctgagtagctggaactacacatgtgtagcacctttttctatcttttttttttttttttttttatgtagagaaggagtttcaccatgttgcccaggctggtctcaagcctggtttcctgggctcaagcagtctgcctgcctcagccacccaaagtactgggattacaggcatgagccacccaacccatcctactctgtgtatttcaaaaatattttttctgcccctctttttgggaaataataattactgcttctaacagttatgtaacagagtgtacatatcatgccttacaaatctttgctgttaactgtagcatccaaagatgatagggtgagtactctgtaagtctggaagaacaggtcacatttattcagacttctcccccacaatttttaatcaagcacctcccagtaacaagttatttaattagatcgattttaagttgacaacagatgtatcagatgaggaaaaaattgagcatgtgtggtgtgattatataatagaattggtttctataaaccatttatagtattcaacttttatagtattactttttcagatgtatggatatatagactattatttactaattgaggctctgcgaagtgtagtgtattttacaaacataattaaatactatcatttaatatgcctgatactaacatatattaatatattttagcatggtttcaaaaattttaattaggaatttttgccttttattatatcagaaagtatattttgcagtcaggcctcaaataaatcattatgaatcttgtagttgttcctgaacttggagtgttaaattttgaatttgccattttttaaggttccagttttttgctgggcgtggtggcttacgcctgtaatcccaagactttgggagactgaggcatgcagattatctgaggtcaggaattcgagaccagcctggctaacatggtaaaatcccatccctacaaaaaatacaaaaaattagccggacatggtggtgggcacctgtaatcccagctactcgggaggctgaggcatgagaatcgctggaactcaggaggtgggggttgcagtgagatgagatagcaccattgcactccagcctgggagacagagcaagactgcgtctcaaaaaaaaaaaaaaaatctactttttgtgatacgtattttcatatataaaagttttaatttcataaatacttggtttttatagtagccttcttttgggttgagtgatttgggctcttaatttttattgccacaaatagcccacagctggtagttgcagactgtaggaattgtacactggtatgatcttacacaggtaattgggctactggaagtagaggacttgcgaaatacaaaggaagaaatgagagatgtacctgccaggagactcagtaaccaaaacaaaaacttccacttcatctaacaaattattcctttttgggataaagttaaagctgaaacgtaggtttgttggttgttctttattttcctcaaacataacttaattcagacttctcttaactttggaaaaacccaacatagataagttggatagattcttttttctattttgcatcattagattttttttgcttgaaacagctgtctttagcattaattcttagcatcttagattcttgccagattattttttactattatttgtcattttattctttaatgaagcagcccttcctgaaatcattcacatttagattatatgttgctggaaatactgaatgttctgtgtattgtgcttaagcatgcaattatagacagtaattaagtacagtgcatttgtttcaatagcttacagcaataagacagcttttgaaagtttatacataagatgtatacaaagatagactgccttcattttcttcagtacgtgagtagggaaaataaattcacaggaggaattgtcaaagaagttcagaatgaaagggaataaagggaagatggggaatgagaaacaatgaagaaaataatagaaaatttgggaaaagatatagaagaaagaaagcagagaaggattaaaacggcctttccaaaacgactctttgtcagtgcacttccattaatcacctcttcaaatgagatagtaataactctttttgcatttttcatttttgcctcacccttactggagaagagaagatgagaaagacagtcccaggagtgtctggtatctgcagccacagggggaaaggaaagagaatacaaattgtcattgtgtcagtagttcttatggctaccacattgggggcagctgtcattgattaatttgagaactccttctgcgatctgttgtccattgttcaggatacatatctttggctgttattttaacatttatttatgacacttgtttctacttactttgacatttggatactcactattagcaacatcttatctttttaattactgttttgtggcttataaaaagagactataggccggtgacgatggctcacgcctgtaatcccagcactttgggaggcctaggctggcggatcacttgaggtcaggagttcaagaccaccctagccaacgtggcgaaaccctgtctctactaaaaatacaaaaattagctgggcatggtggcaggcacctgtaataccagctacttgggaggctgaggcaggagagtcacttgaactcaggaggcagaggttgcagtgagccgagatcgcaccactgcactctagcctaggcaacagagtgagactccatctcaaaaaaaaaaaaaaaaaagaccgtataagaatgaaagtgaactggtacaaagtagttaccattgtggaaaaaacaactcaaatgcctcatagttgaagccaagaagcagacaggctttgcctctatcaacttatatttgaaaaacgtagtttctttaaatctccatttttgtcttttgaatactttattaggtcgctccagagaaagcttgaaagcaaggcctgtactccacttgaaaagattcataaaatagatttgtaaattattattcagcgcatgaatttctcaagtatatgattatactaaattaatattcatatgttgcaggaagttggtgaaccatctaaagaagagaaggctgtggccaagtatcttcgattcaactgtccaacaaagtccaccaatatgatgggtcaccgggttgattattttattggtaggattatatcagtaaaatcgtattagtgtacatatgttatgaagttaacctacatttgggatatgtagaagttttaaaagtgctttccaaatgtgattgttctggtgatggacatatggcagttgattattctgttcttttcttttatgattgaaaatgtctataataaaaagataacatgttttctaataacaattgttggaaatttttttaaataggatttattttcagtgttttaaaatactaccttttgtttagatagtatgcgtacttggaactaagagcactggctttttttccccaaacaatgtcattataagctgatgtcatttataacaccagagcttataagtaggggttgagtttgcctttctcatcaattaaaagtgaattgcagctgggtgtcgtggctcacacctatagtaccaacactttgggaagccaaggcaggagggttgcttgaggccaggagttcgagaccagcctatgcaacacaatgagaccccatctctacaaaaaaattagatgagtatgatggcatgcgcctctgaagtgagaggatggcttgagcccaggagttagaggctgcagttaactatgatcccaccactgtactccagcctgggtgacagagcaagaacctgtctcttagaagaaaaaaaaaactaaattgccagtgtagaggaaaagtcctttatcgtctctttctttactgtttttaatgatttgacattcattacaagttttaaaaagtagatgtgctaatctcttcagatataatatgtttagctgtttcttgtgacagcagtggattgttgacagagcttcttcctcagtgtattagagtaaaacttgatgagaatttttattacttgcagggagtggtgaacattttggtttatctacatatgcttgtgattaataagagtgatagttacatacagatattttaaatttttgaatatttccccattaatttaacttgctttagttggtctttctgaatgccattatttcccaacattacttttaaaagatacttaatatagttcacaagttgaggttttggggaactactaatcatgatcatgttagatttagttttctgttgagtttggttttcttttttgttgccagagtgttgaaattttactttataaaatattatttagatagacataaatccccatgtatgctaaatttaaaataatgaatttcttctttagcttcaaaagcagtggactgtcttttggattcaaagtgggcaaaggccaagaaaggagaggaagctttatttacaaccagggagtctgtggttgactactgcaacaggtactgtttatttcttagtgaagaataacataataattttaaattttcttcatagtcctgaagctccttacatcattaaatgtagtgatactacaacataactcaaatactgttttcacatgtaacctgatttctttggtacctctggaaatgtgtttggtattagactattatacttttaactgtatataatttttatttatgttctattttatatatttgtgagccctactgaagggtcagcaacaaaagtcatataccagtgcctacagtagaaaagaaagttttttcttttgtagagcaaattggttgaggagtctttttttcaaaacttttgcaggaattcctattagctgtgttaccgctacttttttagtgcctgcaccctgagccataagcctcataccctttcctatttggttcagtgtttgctaatgtagtatttcttctaaaatcaaggaagctgcaacatctaccttatctttttctgagaatttcaagatgaaatacagctaattcagtaatatacatatatttttcataatagatactttttctgttttgaaaaaacttttgatgttaagtggtttacctaaaagacaaaatcaccttccttttggaaggaagtatgctggtttttctttccatttcttttcttttttttcttggtttacttaatactaagcattttcttaatatatgttaactaaattttgttttcataacactaaagcttatcttttgggattttagattattttatgtgtactaatattttatttaatggcacctaaagtatcagccacataagaaccctcttaaaaaccactatttcacaacctggtttcttaagctgtcaagttaaagaattattgaatatttcttaaaattcttagttgccaaagactagaggttactaacagaccttttagaaacagtaggtttcggccaggcacagtggctcatgcccgtaatcccagcactttgggaggccgaggcaggtggatcacaaggtcaggagatcgagaccattctggctaacaaggtgaaaccccatctctactaaaaatacaaaaaattagccaggtgtggtggcgggcacctatagtcccagctactcgggaggctgaggcaggagaatggcgtgaacccgggaggcggagcttgcagtgagccgaggttgcgccactgcactccagcctgggcgacagagtgagacattgttgagacaaggatgagctaacactcatgcagttgatatttgcttgtcttttgtagcaacttgtctagttagaattagctccagcaagcatatatccagggcaacttgaatctgctcgtggggaaaaaataaaaaggtgaatagaattagctccacggtacaaacttccaggctgggcacagtggttcacgcctgtaatcctgacactttgggagaccaaggcagggagatcacatgaggccaggagttcaagaccagcctggccaacatagcgaaaccccatctctactaaaaatacaaaaattagccaggcgtggtggcatgcacctgtagtcccagcaacttgggtgactgagacatgaaaatagcttcagcccgggaggtggaggttgcagtgagccgagatcgcaccactgcactccaacctgggtgacagagcaagactctgtcttaaaaacaaaccaaaaagtacaaacttccttacctgccacaaaactgatgtattttttacatgttgtgtaaaaattaagagatgctacaaatgcagaaactggggcacagagaacttaagtactttatctaaggctacacagctagcaagtggcagatctagggttctacatctagcagcctgtctccacagtctgtgttcttaactaccgctctatactgtctcctccaacaaaatgacgatgcatttaatggagctattagatctgtaagcccaaatctctgagtagagcagccagtatgaatccacattttttggctttttaggagccttggtaccttgttatttgaaaagctcaaaagacctgagtacagagagtgtccaaagacactcgattttcattgtatacgctcttcccactgatgtcagattgtttgagtcctttctgcactaaaataaatgagaatagcataactttaaggtctccagagccacttctaatataaccgtagagtcttattggccagttctcatgagttgctgcccaatagcagacaaaatcacaaagggtctcttgaccagtttctttttttctttttttggcatcctccaatactgtcagtttttctgaggcagctaagtggcatgagggagtctgaggaaaaacaaaataggaaaatgtaggatgataaaacaatcttttctaatgtgatctatacctttttatggcctatatcatgaatgaactcatacatactaggttaagtctccacaagactttgtatcactgacccccaatccagttatgtcgtcctcagtcttgtgcacatgccacactcattttttcttctagtctttttcctatcataacttgccactttccctaaacggttctgtttcctctgtcccacctgcctctcaaaatcacaaacaaatccctcaagtccttcctctaccgaatgtactcttccccaggccctccagccttcatcagcctttgtatctaaagttctactgagtttatcaagttagtacctcccagtttggcccttaactattttagaattgctacatatgtgtgagtttttttaaaatctcctgccagctaaatctgaaaacaattgtaagactgttttatactttattgtaactccatagcaattaccacagtgtgagcacttcataaaaactcacctttgccacattggtggaagtccccaacatgtctggcatttaataaatgtttgttaaatctgaaaaaaaaatggaagtgaaggaaaaaaatacagaagtaattttttaaatgttttagaagctgttttaaaaccacttactcaacaaatagtctaggctccaggaatacaataataactatgacttggtccctacatcaaaacatattctgatctgttagggaagatttataactaatcacaatgcagtgtgttgaataaggaagagagagatggtgaaactatgaagaatgacatcacacagaaaatgttttaagtaaattttgaaacataaataggtgattacccaacaaacaagagaagaaaggaaattcattccaagcaaagggcatagaacacaccgagataggaaagtatgagtagttgtgtaaaaatgtcagagagttttatgttagtaatgtgttctatgtcatgggtttaaagccaaacaaacggaggctctgatactatacaaatgttaaataatgtcagtctcatctttcaacctaattgtgaaattattttcaacacaatttgattgaaagttaataatctacttttctttcgtgggggtgggcagctgtgcaggaaaattgacagaagcagatgatcctgctggttctattgccttcagtatctactcatcagggaaaaggcttttttctactaaagttgcattgtttgtttttaaaattctttattaagaatcattttttccactaaagtaaatttaagaaaatgggaactgttgcaaatgatttagaagaaaatccaaattactaataatgttgcttcgtagatagccagccacattaccatttgagaatatatacttcaagtatctgtatgtgtacacatgtactcttaatatatggacatgtatattaactgcattataaaatgctgctttttcaattaacatatgaggaacaggatgtatttttattttcatttggagtggaaataaatgttcctgaaagaaaatctggaaatcatataagtgcacaaagaaaattagaatatattttcattatagattttttttgtaagacattctggagtaaaaaatgtaagactacacttcatattcaaatatgccactactattcttaaatcccactttgtactcataagtagttaatcattaaggtctcatttcagattcttgtttgtttatatatgtatatgtattcatagcagatatgatggtagcattttgaggggcagtttgaacatttgcacaattatatgcacaatcatatttacataatttaaaaatagctcttccaaataagtagtatgggccaaatgaggaaacctagaaattagctttgtggaagtgctcataggctggacctaattggggagcagatggaagcccagccaggcaggtaaaacatagaaacataggtgcttcaggggactgaacacagtgacaaaaagaagtggttatctgggcaggaagaaagcatctagttaacaagtgctgtgatgtgctggagcaggcaccagtgaggtgtaagtagaaaggtagctagatagtcaccattagcaggcaccagtggtggtagtgagacgtagcttctagattgtattgtggcaattagacattatcaaagcaggaatggagaaaccaatcagaaattctgaaactagaacatgagatttgaaaaagtgacttttagatgacaaaaataagggcaacccaatttcttgagtaggattgtaaggttaaagagaaactaccaagcaacgttgacttaatctggggtcagataaaaaatgaataaagcaaggatctctctctctcttaagaagtttaccgtctagtgaaggagcaaacaactactacaaattatatagtgagttagaagataagtgctatggatagggtaacaggaaacgagagaatgggaaggtgggcttatgttttaaacagagtaggttgtggttgagggaaaacttgaaggaagggagtgaaacaaaaggacctgcttatttgggggaagagcattctaagtaaagggaacagccagtgtgaaggccctaaggtgagaatataaaatatagtaataactgataaaaagagagaaaacaatctatttagagagaaattagtgaaaccaggaatacatcatgttttgccaaatatattgcacatttttcaatttgatgttgtgcacgtccttttcagagtccaaaaatctcaccttagtatatttaatcattgcttaattgaagataatcattacagtggcacactgaattgcgaagtacttggagaaaaaataacaccaagaaagctgaaaagacattatttggacccatcaaatcatcacttttaatctgttaacatttcttaaactgtttattttctcctttctttattacgtcagctcttgcatttgagacttaacataaagtgaagctgagtcttgattatatgaacccagaaagagtctttatatggataatctcaaacctataatctcttttatacttaaggtacatcattaaaagtgaaaattatattgaatatcactgagttttgacaacttttatataattgactgtaaagtgttttgatttagtggtagagttgactactttttcacgggcatactagttgtaatttctcttgtgttgctaatttatgccttcctttgcttattttattcaggtcttgatatttttgcttttcagtctctatctatatggggagtgtaatgccatacctgtttttcccaaaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggtgagttaatctaaaattaagtaaaaatttaaaaatcattatgtgcacatgaacactactggcctatgagcacatttaagtattatgcaacacctacctgagataactatattagagttgttataaataccgtggttgagaatttttatttctgtgttacaaatagtcagtgaaagttttttgactgtatgaacatcatatttcttgcttacttgtgttatttcttctgtccaacttgtgttttcataggaggaaactccaggaactcctaaaaagaaggaaactaagaaaaaattcaaacttgagccacatgatgatcaggtttttctggatggaaatgaggtgagagtaagcctataactagaagttcagttttctataggagtttttagaaagatgtttgatgccttcactaataaaaggaaaaattttgagaaatctaattatgctcttaaatgtataaaagctactccatttttaaaaatcaataatttctcttatttagatttttaaaagtcagatttgactgtgagtgataggaaacctgaaataaaagcatcttaatacaaaatagatgcttatttcttttttatcagtgaaatctgtaggtaagctgtacagatacgtcagctccatggtggatcccagctcttcttttctcctctgtctgaggcttctagctaaggttaccttatggtccagaatgactgccaatcttatatctgcatcgaaaagaggaaaggagagtgaagaatatgtctcctctttaaggagaccagtttaaggacactgtccagaaagctggtaatttcatttctgcttgaattccattggccagaacatagtcacatggtcatgcatatgagaagtaaaatcttggaaatgcactttttatacaggatgattatttgcccagccgaaatgtagggtttccattattatcaaagaaaaaagagcagaataggagatagctacaagtctctatctcttacagaatgtaagtcagacacatcacttgaggggcttaaaatttttaacatttcttgatgctttatgcttatcatttgtaatggaagatttgtatggtggtagccttccataaagactgcttaattcagtcacttcaccagtacgtaaacatgagttatatactgggcattgaactgttgtgaatttcaggatatatcctttcctgttatacctatacaatagtaacatctataaagtcatggctcctagggttgtgtgtttgaaattcttacttgcatgagactatctagagtgggattgtgggggaggattatatatctataataaagtgtcctcaggtgactgatgtgaaccccttgttgagaaccactgtaatagaaatttttatttttataggcgttgggaatagcttgataagtaggataaaatctcttaatggtctagcaaagatacaggcacttaaacatgttaatatagtacagtgtggtaagcattaatggtgtgaaagcaccaggtaggaatagttaatttagtcaggaaggataagaagggtctaaaggacatttgagcttagacttgaagatgactggcagattgccaggcgtgccaggaaggaggttaggtctgttagggaaggaaacagcctgagcaaacgcatgggtgcttggtatcctgagaagcctagattttattctgtagaaagcagcatgcactccataacttttaaagttgtgaaatatcttttttaaaaaaacatgtttttttagaatggaaactggcagaagtaatatctgtgaatctgattcccaaggaaatgggcagagtaaaataagaggttaaagtggaacctctggtgttaaaaattgaagaaccacgttggaaagacaataaagagttctggtcaatatagaaataagagggaagagtactgttatttatagaaactaagaaataaaactgagttttatggatgaatgatcaaacagagttctgatctgaatgaagtaaatttctgttgtgtaaaataagagcctgataaaagtaaattaagttttgaagtagtggttcccagcttatgggccctccatggaggagtaggcaatgaaattaatacagtcatagagactatgttcaccaagcatgatctttaataattgatctttgtgtcttctcaggagagaaaagtgtggagttgagtgatactagatctgtaatagggcctggctggaatctgtcttaactgcgcttttatcccagactggttcatcattacattagggacaaaaaggttggcagttgctggtgttttggttgaataaataatgatgtgcacacatggaacaatttttttttcccccaagacagagtcttgctctgtcgcccatgctggagtgcagtggtgtgatctcagctaactgcaacctctgcctcctgggttcaagcaattctcctgcctcagcctcccgagtagctgggattacaagcgtccaccaccacacctggctaatttttgtatttttagtagaggcagggtttcaccatgttggccaggcttgtcttgaactcctgacctcaagtgatctgcccgccttggcctccaaagtgctgggattataggcgtgagccaccaagcccagtcaaacaaatttttaagtgtatgtaagaacatacaaatttacttaagtgctttatagaatttatagttatcctataatcattttctagcgccagaagaaccactactactgaaggaaagatctttggaatttatttaccttagaaattacttctcgtatgttaagaggttgatgactgctttaagggacctaaaatatagaattaagcattactttctaatgtgacattagaacttttaagcaccgaggtttcttgattcttctaggtgtatgtatggatctatgacccagttcactttaaaacatttgtcatgggattaattcttggtaagtagtgagatgttaatagctataaagtgcaatctaaaatttagaaaacaatatgcagatactgtaaaagaaaatgttcctaaatttaacataaaatagttgtcattttaaaaatactttaaataaagtcagaagataaataatacactaaggaaaatatttgaaacatattaaagatcttttaagagattaacaaactgatagaaaaatggtcaaggtagttaacagataaagaaatacaatgaccaatcatcatgagtgatacttaatcacactcatatacaaattaaagctgtagtgattaagagtcttgcaaaccttaacattaaaggtcttagaaaaaaatcagctctctctaacagttgataggtatgtctattgttttaatttttgtaaagggcagtttgtcagtatctttgaaattttatgtgtctgcagtgacccagcaattctaggctgttcccatacagttgcacaaagtgtgtgcattgacacattatctgtttttttccaaatcccttagactatacttgagtataatctagcaaatatctttcaaattcaaaatgcttataccatttgatctaataaattccactttaaggaatttaccctatgccataatcacagttgcacaaacgtacatgtgcaaggatattatacctagaatagataaaaaaagaaaagaaagttacagacgagtaagaatagtataagctcatttacttatttagaaaaaaagtccctgtagctagttaattatatataggcagtctctgagaatacaggtaagcttaatagtacttaacctctgggaagtggaataagaattagatgaagacttaattttctctataccttttgatttgcttgtttgtgacagggtctcattcctgtcacccaggctggaatgcaatggcacaatcatggctcactgcagcccgacttgctggggtcaggtgatctcccacatcagcctactgagtagctggaactataggcacactccactacaccccgctaatttttgtatttttttgtagagatggggtttcgccatgttgcccaggctggtctcaaactcctgggcacttgcctcgttgtcccaaagtgctgggggtttgatttgtttttgatttgctttttaacgtgtgtattccaggaggttttatggggaaagaatgatttaacaaacagaaaaaaaaaaaataggtagcagttaaaataagcttggtcaatatggtatgataggatcccattcaaaataactctttaaggctgggctcagtggctcacacttgtaatcctaacactttaggaggccaaggcagggagatggcttgaatccaagggttcgaaaccagcctaggcaacatggcgaaacctcgtttctacaaaaaattagccgggtgtggtggttcacacctgtagtcccaactacttagaaggctgaggtgggaggatcacctaagctcaggaggtcgaggctgtcgtgagccaagatcatgccactgtactgcagcctgggtgacagagtaagactctgtttcagaaaacaaaaagcaaaataactcttttataataagagtactagtcactttgctagatattttgcgtacaatatatcatttcatcctcacaacaacctttgaagaataggaagagacttattaaatataaggtaacttagcctcaaaagagttaagtaacttgcccagggttacatagcttataagtgatggagctagaattttaatcctggtcttattctaaagacctaataaccaggcttctaatttcttataattctttcttgtgtccccactttacttgcaaaaaaactggagacacttgtaaacagtttccctaagcaccaaaaaatacatctgtagcagaaatcacctggggaatctttcagtctgtggatgtcagagctccaccccagaagaagaatctccagagaggggtcttggaaatcattttttgttggctttgttgttctgttgtttcttttagctcccttacttagtaggcaaatatcttagtattttttaaataaagtagatatagcttgaaaaagggggcagttgataaattaaggaggcaacagttttgaatttctacatagcatttttttctaattatatgtaatttacactaataaaaactagtttaagaatagtataaaatgttaggttgaacaatatgaaattgctcataattgaccattttttacctataaaaatggcaattttatatttcactgtgtttatgtttctcagtttttcccccagggatatgtttctgttagtgcagccataccatttaagtttttattctaaaatttaacttttgtcatttcttgttccagtgattgcagtaatagcggccaccctcttccccctttggccagcagaaatgagagtaggtgtttattacctcagtgtgggtgcaggctgttttgtagccagtattcttctccttgctgttggtaagtattgttattataaaattgacctcaagaaggttggtattgagcagttggactgtaatttggagcttcagtaaagcttaagaaaaattaatggaggtaaatcaagaaatatatggtactactttctgagtcaaatctcaaaactcaggcttggtaagatgtgttctgtctgcagaaaaaggatttaatacatctttaaaaaaattttttaataagattattttttattgacagatcataattgtatacatttatggggtacaatgtgatgttttggtgtatgtgtacaatgtggaatgtttaaatcaagctaattaacataattagcatattgatcacctttcttgcctatcatttattgtgagacatttgaaatttacttattttgaaatataccatacattattatatcttaatctgcaaatagatgtgctttaaaaattagttatggcagaggcgtttaatatttttgcagtggtagatcatttattagacataatactttcagtaaaacattttttaattttgacttagaacaaatgcaacatctaaataatctatgcatatatttaataaatgattctaaacaattgatttgccattttgggaaaaatcaataattttcacccaagtaccaaaatactagatgcaataaggagttaatgttttaaaaatcaaataggaaaacataagtaaatgaattttccgcatttctggatgattggggtctttcatagattatttgtttagaggcagggtcttgctctgtcacccaagctgaagtgcagtggtgagatcatagctcactgcagccttgaattcctgggcttaagcaatcctcctgcctcagcctcccaagtagctaggagtactggtgcatttcatcatgcctggctttttgtgggggagatagggtatcactctgcccaggctagtctcgaactcctgacctcaggtgatctgccctccttggcctcccaaagtgttgggattacaggcgtgaaccaccacgcccagcctccttcctctgatttggtaacctctggcagcagaaaaatcccctgctggttttgcatggaacacgggcacatttgtaggccaagaaacaatatctaagcctgtttgaatttagtgtcagtgtaatacctgcatcaagaaggaaaagtcataaactttgatctgacattagacataataaaattggtgctttttgcctttcaaattcctgaaatttagaaactccttggaaatttttagcaaaggtttagctccactgaatagaattattctacttgcttatttttaaattaaaccagtgttcacaatagtttatggttattatgtagttttgctgtttaaaatattgtttcttcagtagtctctttaaataaattttcattgtaaatatgctgtggatttaaatatgcattatgaaccaaatagtcttctgaattataccaggaaacaaacccaacattttattttgattctcttagaaaatgcaattccaaatatactttcaaataattagatatttcttttatattattctttgaagtctttatatatattatgtatatcgcatataatatatatcatgtatattatatatgaatatatatgatatatagatatatgatatatcataatattatatatcatatatatcatataatatatatcatatgatatgtcatatatattatatgatatctcatatttatatgaaatatatttttatatatattcattttttggagacagggtcttgctctgttgcccagggtaaagtaccatggcagaatcatagctcactgtaccctcaaactcctgggctcaagcagccctcccaccttagcctcctgaatagctgggactataggagcatgttgccatgcctagctaatttttttttttaaagtcagggtcttgaaatattatgtattggtcacaattatatctggtgtttctttgaatatgcattattaataatgccatttaaaataaaacctttggcagttttctaaaatctgtcgcttttagcataggaatgttattatagtacatgtcacagcttccccataattcttcccttttcactctcggtaatctagtgccacatagcgaaaaactgtaaaacatgaacattttgccataccatttgtatgtgataagaaattaggttagtgccatttctatattgctttttctttggtttgatacaagatttcatattatgaatcatctgtcttacaatcctgtaaaacctatcattgcatcataattggagaaaaaaatgtacagcctccttaaattcattatctctgtttatcagtggaatttattcttaaatcataattttaagcatatttaccttttccgtttataccacgaaagattctaatgtgtacaggagtctttcagaatatttatattcttgtgaaaataaaaattgctatttttaaaagtcaagacagctataacgattttcttccatttatacaaagcaaaataatggaagacacatagattagcttatttcaggctttatatgaaaacagtgacagaattgtctaaagaaaacaaaaaccaaaactcctgtcataattgattagtctgtaacattcacataatcatcatgaccttttaaaaaacaggaaaaaatcactcagctctacataattggtaaattcagagaaaactaaatattggggtttgtgataactcattactacaaattttaaaattcaaattccatttttctacagttttttcataatacagtgttataaaagagtaaaccttatgtatttaagtgatcttgctttcattaacattgtatttttcctaatattgagaggattggtctttaagcaaaaattacatagtttacctaactaataaaacaaaaaggtcaggttcagtgactcacaactgcgatcccaactactcgggaggctgaggtgagaggatcacataaagccaggagtttaagactggcctggacaacatagcaagaacctgtctatcaaagtaggtagataggtagagagagagggaggatagatagagagagagagattagataaataaatgatagatatagacctgtaatccctgcactttgggagtttgagcccaggagttcaagaccagactgggcaacttggcaagaccccatctctacaaaaaatacaaaaattagcggagcatggtggcacgtacctgctacttggaggctgaggtgggaggattgcttgagcccaggaggttgaggctgcagcgagtcatgattgtgccactgcactccagcctgggtgacagagcaagaccttgtcctcaataaataaataagaaaacaaggattaaaagatggaaactttctaatactggggttccttatccagggctaatttatcctttaggcatagtaaacgtgtgccttggaccaagatacatataggggtccacagaaatattttcatttttatttcttttaaatcagaagtagtaatgtatatacatgtatgtaatagcaaacctatacagtattttattcgtgtttatacagatgtacagaaaatatagtcataaatgtatagaaaatataatatttaatagtttttgtggagtaagtgccttacaaaggcaaaagggcctagggccttgggaagtatgatgcagccctgcttttccttcttaaaggcttccttcctaaacacctttcatctctttattttattcttttcctacaccatgatcttatgaatacttaaattcccaactgattgctatgtgtattgaagcataatatcacaaagtacataaatcagaagtgtatatccatgtaagtgtacacccagatggaaaaaagaagtaatttttttcagtgacattattgcattgtgacctcaagttcagagcaacattctgtgcccctagaataccgtgatagctgctaaactagtcaggaattttttgttttcaggcatgcagtggtgtaattatagctcactgcagcctcgagctcctgggctcaagtgatcctcccaagtagcttggattagaggtttagccaccacgcccagcactaatcaggatttaaatattaatatttaaggtgtatgaaatgtgcagataataaaactgttttcccagctttttattaacaaatactcccttctgaggcagtgtttgaattactcaattagagaaatttttctccccacagctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaatagtgtgttaagtgctacggcagcaaattgctacatgtgctggatatctcttgttttcccctccagctccactctgctcttgcccacaaagctgacccgaatggaccacagcagtgggctcctatgcctcctggcttctgagtgggtttggccaaggagtgtcctggccagagatcagaggatggtagggtgcctattctcggctcttctcctggggttggggggctgccttagcagccaaaggtcacttctcccaaactccttccctgctttccaggttgccagtccctgcactcttcctttctggccaaggatgatgtcagttctgctgctactagcctggagttgcagaagctactgtgcttcctctttgggtagcctatacctatacttatctcctcataatatcttcatgtaaagaaccatctgtttcttattggaatcaagaccaataccaaggagaaattcctagggaacaaaaattccaatgaggaattgacctctttgtcagatccttatcaccaaacattagaaaagatctcataactttatacagcatgttgtaagcattttgataactaaaatcctgttctagtgaatgtcatgcagataactacacaaggagattaatttaaatttgccttctttggcaagcccttaaaccaatggctaaagcagttagttgtgagtttctgagtaggtcccaatgcgtttatttcatttgtccaacctagcacagagatcctttgatactttaattgcatggcttttccaatcagacgaaatttcagtctgagagaggacatattttctgaggtttatagttttaggattgtccaaaaggcctatgatctcttcttagcatgacagaaagagggaaagataagttaaatttcaagggggtcatatcatcacactttggtcttatttcattttcaatgatttcctagatcactttaacttttttgtgtcatggactcctcagaataatgggttttttttgtttgtttgtttgtttgagatggagtctcactctgtcacccaggctggagtgcagtggcgaaatctcagctcactgcaacctccgcctcctgaggttcaagtgatcctcctgcctcagcctcccaagtagctgggattacaggcacatgccaccacacccagctaatttttgtattttttagtagagacagggtttcaccgtgttggcgagactgatcttgaactcctgacatcaggtgatccacctgcctcggcctcccaaagtgctgggattacaggcatgagccaccatgcctggccagaataatgtttttaaatgcagaaaaggaaatgcatggggttacaagggaaacgaattacactgaagtgtaagctaccaaataatttatgatgtggtagttataggtgtgcatttaatagccagatctacgagtggatgtaataactgctatgatgttgaagtagcataaaacatatattagatatctgcaacaactgtgatgtaacatgaaaatacctgatttctgttgacaaagttactgctagtacaactgtggattgttgtctgcactcgtcattgaaggaaatactaaattttagttttaggctagtgaaattaaagttaatttttcccatccaagttcatgtatcttctgaattctatccgtgaatcccttagaggtctgtgaattgtaggttaagaacccctgccctagctaatcagatccaccaatgtttcaaataggactataacttattcaaaggccaatgatacttcgcataattcaattttaatattattcacatttcatgtcacaaatttagtaagttacatgtgttatgtgatgttttgttttgatagattatatcttactcctaaataaaaagtcaagatttttgtagcaacttctatttattttatgtatttatttattttgagatgggggtctccttgctctgtcactcaggctggagtacagtggtacaatcacggctcactgcagccttgacctcctgggctcaagtgatcctcccacctcagcctcccaagtagctgggactacaattgcatgctaccacacccagctaattttataattttcataaagatggggtctccctacgttgtccatgtcggctttgaactcctgggctcaaatgatcctcttgccttggcctcccaaagttgtggattacagatgtgacctgccatgtccagcctgaagcatcttttaaatgggagaagcaaaacaggatcttaccaacactaagattatctttcagtcattcagcaaacatttgtggagtgattactatgtgctaagcattgtgcaatcacaaaactcaaaaagctagtttagtaagagagacaagtattcatgcaaacagtggcaatggtgttgtgtaatgtcaaaagtatctgtgacgtgcttatgagatcacataagtgaatacccagcccagattaggaaggtcaggaaaggcatcccatagaagtatcatgagctagatcttgaagaatgagtgggtattagccaagtaaagactaggggaattttgggccactgcagcaagatgtgcaaaaataagacagcagagtgagcatggcatcccctgaaactgaaactagttaaggtgcagctggaaaagagaaacgtttagagagggatacaggtggcaagtcattgtttgaccagaatcccttcctttagaaaatattcctttcccttctgtggtgctcctcattccattccacggtgactggcctcaaggatgagcactcagttcacaccaggccaattgaagtcttctcatttactcaggggtcttgaattccaaggaccatgtggacctgaagaaaccaatggctatgctgccttcacatgaatggagcctgtctagaaatagaaccaacatgaaaaaaacagaaccaagggtggatcaggaagacaaggccttaatgccatctttgaactcccagatctagcctggcctaaagccatccctgggcttttcagttgcatgagccaacagattcatcattttttctcagttattttgaatgagatttctgtcactgggaactgaaagatgactgagttgcacacagtaagtatgaacagtgacactaaaatacctttggagcagattgactcaaagcaggagagtgacacattcagatttgcatcttagactacactaatcacatagaaaatggcatggcaaggagcaaggcttagatattttctggatacttccagtatttctcagatttacacattctaaccacaactcccctcttgttgttaaaaacaatttattttcttattacggaaaaatcagaaacttataagcaaaaataaccagaaaactcacaaacctactgtcttagtccattttgtgtagctataacagaataccacagactgggtaatttataaagaaaataaactgacagggcatggtggctcatgcctgtaatcccaccactttgggaggccaaggcgggtggatcacctgaggtcaggagttcgagaccagcctggctaacatggcaaaaccccgactctactgaaaatataaaaattagctgggtgtggtggtgtgcacctgtagtcccagttacttgggaggctgtgacaggcgaatcgcttgaacccaggaggcagaggttgcagtgagctgagatcacaccactgcactccagcctgggcaagagagtgagattctgtctcaagaaaaaaaaaaagaagcttatttgactcatgagtttggaggctgagaagtccaagagcatggcactgggatctagtgagggctttcatgctgcatcccatggtggaaggcagaagggcaagacaagatgaaagccagtgagcaagagggggctgaactggcttttataacaagcccactctcatgataataacaatgcatctgtgaaggcagagcccttatggcctaatcacctcttaaaggttccacctcttaatatcatcacaatggcaattaaatttcagcatgagttttgagggggacattgaaaccatagcacctaccttcagagacaactactgttaaaactcatatatatccttctatagctcttatatgtgtaacatgtatgtctctgttcactgaggtgaggagatagtaaataaatgggatcataccatgtatactttatattaagagtattcagaaattaacgatctggaaaaagaacatgttgtgtggaaccaaagacaccattttttcagaagaacaaattattgaccagcttatgattttaaattgtatttctgctcaccaacttcaagcttcagattgtgaagttatccttagactaagtatatagtaaatgcatgttacaaagtatttcacattacagtgtttttaatgatcaacattcgaggggattagaaggaagaatttattattaacttgccatatcctcaaatacatacacctttaacaattatggcactttgcactgcaaagaaaaaaataaagggcagtaacaagtaaattagtacacaacaaggctcttgaaaacaagagcagtaactgcagaaactggtctgtacttacagagtctggacaatatctgacagactgcacagctataaagagtggttggatactatataaagcaaagcaagttgcatctctatcccatctttctagttgcatatactccacagggttcaattacaaaattgaaaccctattcttaataactttttttcttattgtcctttaataaaagaaccatcagaattctccacttttcaatcgcatatgctgtcttctatctcaccttccatcccacccctaatttagtctccttccaaaggactgattgcaaatttcactacttaacaaacaacatatgcagccgggcgtggtggctcatacctgtaatcccagcactttgggaggccgaggcaggtggatcatgaggtcaggagatcaagaccatcctggccaacatggtgaaaccctgtctctactaaaaatacaaaaattagccgggtgtagaggtgcacacctgtagtcccagctagtcgggaggctgaggcaggagaattgcttgaacctaggaggcagaggctgcagtgagccgagatcacactactacactcgtctgggcgacagagcgagactccgtcaaaaaaagaaaacatatgcaagattcagatgtctcgtgcttccctctgcctccacccaaagtttcttattaacagtattggtgggagcatgacatgtttgtttgaacagttccatcaatgccaagccacgattatacacggataatgttcctatagaagggaaccaactcctggaaaatgagctcgaatgttcagccccattgccacctcacattctttattccccaccacacagattgagagggatgcggtgaccagacagaggaatgccattgagactcccagcacagaccgtagactgcttttctcaggaggcaatggcagttctctgcaatactcagaaggcaagtcacctgaagaatcttaaaactggagacctgctgcacaatccttttctttcttcattcagccaacatttactgagcctcgactatatgctgaacaataatataaatgaggaacccacagtcccggctcagaatccggggaaggagcaaggaaaccagcggctgcctgcacatgcacacgttgccggaggagatccatcttctgccctaaaagctacaatctccgccatcggaaagcttccagcctggtagggttatgataaggcaaacaaacaaacaaacagacacaaacaaagtgctgcaggctttgagaaagaagttagatggtgaaggattgcggaggcaaaaagaggcgagcgatcagagagctcttactccacaagggaggattttacagcagccatcactccttagtctctgtttcctttttatcaccgacacaaatgcttctgagaacttggaatactgcccaccaggagtttacaaatccaagtgaaaactaaccactaactgacggagtagaaaggaaaggaacaggccgggcgcgaaagctcatgcccataatcccagcactttgggaggcagaggcgtgcggatcatctgctctcaggagtttgagaccagcctggccaacatggtgaaactccgtctctactaaaaatacaaaaatcagccgggcgtggtggtgggagcctgtaatcccagctactcaggaggctgaggcaggagaatcgcttgaacccagaaggcagaggttgcagtgagctgagatcgcggccactgcactccatcctgggcaaaggagcgagactctgtctcaaaaaaaaaaaaagggaaaaagaaaaaggaacaaaagaataactccttgggcctctggtatagaggcttccagcacaaagtcacaatatgtgggacaatatcaaataagcattccatttatcactaaaatatcttgtgtttaccataaagtgaaacctgcttaaaataaaatccatcaggatgctcattttgttcaccctacccccacttgccacattacaaagaggaagcaacaagacattgttcaatgctgctgagaacaatttcatttccttcctgttcactatcttttttgatacaacatgtaattatgggaatttttaagaattttcaacaaatgtcttctataaaacttagtcccttctgtagcaacatacgatccccctgcaaatcaaggtagctaggaattgtgcagtgaaagagagtggtttgctttaatgttgtgtgcaactaacttcctgttgccttttaatgttctgctgctagtacagcataattggataactaataacaaatacacgtggtgctgattttgtttcattaaaacatttacagaagctcaaagttaagcatctgaaacacctgattgatttttgtttttcactacaatctttttatggcataacatatgcacagctaatgttttaaaataaaatgtaatatacctaaagaaaagtgtacaaatcataagtatatggttcaatgaattatcacaaagtggacacacccatgtaaccattggaccaagcggcagaacatcagctcctagaacccccactcccagacccgggggaaccctctcagccacctgactcctcgcctcccacaatgtacacttttaacactatgggttcgttttgcctgtgtttgaacttcatgtaaatggaatcatattatggagtcttttgtgttggacttttcaatattgtgagatccataatgtatataggagcagttccttcatgatccttgtacagattactaatgacaccccagatgggagaatgacccacaactgatgattatgaggtttcccacacagtgagactccaagtacaactccatttcttcaactccccattctaacattgatgaacagagcctccattgtctgctgaggacatgctactggttagaataataatttccagagaactcttctaaccattgtaactcagtccctgctaagaatgttgctgttcacttcactgtgaatccgctagtgaatgctgagcacctcctgtgtgagtcctcctgtgagtgccacagggaaaacagtcccagccaggaagcagctcatataattcaaggacatgatctgattaagatgataagagaggtatgagttgccttgggaattttaaagtcagaggaaatcacttcatttgagggatcagaaacaggcctttgaggaccagtgggatcgacaggctaatctgtgggcacacctcaggccaaggttatatcctgagtaaaaacaaacaagcaaaccaaaagagacaatggggcattttgtggaaaatatgaagggtcctgagtggcttaatcatagggaatattgggggttgagtctagaaacccaagtaaggatcatattgtaggagaccttaaatgtcaaggcgaggaagaaatttactctggtggcttttttcactggtttctgccctgctgacctccctttccaacaactaacttttgtccgccttgcttctctcttaggtgcctttctctctcccttcgctccttgtttttgttttaattattattattatactttaagttctagggtacacgtgcacaacgtgcaggtttgttacataggtatacatgtgccatgttggtttgctgcacccatcaactcgtcacttacattaggtatttctcctaatgctatctctcccccagccccgccaacccctgacaggccccagtgtgtgatgttccctgccctgtgtccaagcattctcatatcgctccttgttttttttaataattcttattttccacttcaatttaacccactgcaagctggttcctgtacccaacttctgaaattactcctgctgagatctctgtacatctcagagttcttggttgcaaagaactgaaccagctctggctagaggaagcagaaatgggattttctagggaagggtgcaaatggctcccaagattgaaaggaaggctggaaaagaaagcttagaaaacagaaaggaaccaggaaatatccgacagcccaggaccagccaccagaacaagctacttaggtcttcattgctgttgcatcctctcgctgcacctctgccttgactggtctgactgccccaactctttgcatcactcttccaagagtcaaagtcctccatggcagcatccactggttgagcttggatcaaggggtctggcttctcattcagaaaaaaagaagtatttaccctcacctcagattcttttttttttttttttttgagatggagtcttgctctgtcacccaggctggagtacagtggtgccatctcggctcactgcaagctctacctcccaggttcatgccattctcctgcctcagcctccccagtagctgggactacaggtgcctgccaccacacccggctaattttttttgtatttttagtagagatggggtttcaccgtgttagccaggatggtctcgatctccggacctcgtgatccgcccgcctcagcctcccaaagtcctgggattacaggcatgagccaccgtgcccggctacctctcagattcttagtgagaggcagagtcccccaaatagtgaaatatttgaatgagtacaaactcacccaactgctgagccaaataacctcttttcagcctttatcccactttatccctgcatcgttcctcaccatcagcatccaaaccttcacctctcaccttcttaaaattatctcttccaagcttggtgtggtggatcccacctgtaatcccaacactttgagaggctgaagcaggagaattgcttgagcccaggacttcaagaccagcctgggcaacatagtgagaccccccctctctcccaaaaataattttaaaattagcctggcatggtgacatacacctgtagtctcagctacttcaggaggctaaggcagaggatagcttgagctcaggaggtcaaggttgcagtgagccatgatcctgccactgcactccagtctgagtgacaaagggagaccctgtctcagaataataataaaataaaattctttcttccttcagcatccaggacatggcttttttcctggttctttttttttttttacttctggccactccttcttctctatttgctcctgaaactttgagtctccaaaactccttccttggtacatgctcatttgaaacactcccttgggtaattacattcatttcctttgcttcaaatgtgaccctcaatcttttgctccaacctggactttcactatgagtctcagtcccatgggcacctcaatattaacatgtccaaatggaactttaatggaactttaatctccatccctgcaggcctgctcccctttctgaccctaagtcacagctgacccagctaaaaattcagtcatcctgagtccccacgcatgtatattagtcaccaaagtctcttcactctacctcaaaattatcctttacttactaaagtatgttaaaagtctcttgactctaccatcttgcttctcaattagcttagacctttatgatctcaggaggagagtggtagtaggcggggttgagatggggtggatgcaggaataactaagaagataaaggatgcaaaggtggattgtggagagggagaggacagaatttagggtgatcccaggtttctggcctgagcaactagatggaccaaaagaaaactgtgagactttagaagagcatctagtttggtagttcagtgttgaatatgttatgttaaaatgggacaaccagatgcaaatgtccagcaggccactgatatatataataatgtgaaggtgggagaaagaacagaattagagcctccagttgtggagtcatcagatcaaccatcagctggtggataaaatcatgaaagtggttgatattaataagaaggccaaatagagagggaagactcttgagtcaaggttggatcgtggagacatcatcatttcagagcagagatagagaagcacatcaggaggctggaggaaaaactccgagaggtaaaagctaagcagggaaagcagtgagaccagccaatggagaaagagtcaagaatgaagctactaacagtggagtcaaatgcagcagggattgcattgggctttgcgatatggaggtcagtttagtgcttgcaagagcagtttcatcagaggctggggaagagccagacagcagcaaggtcgagagtgaatgaacaggaagtggtgagatgtgagcgcaatctttcaaaatgcctggctgagaggggaaagagtaacaatgtaagtaactagagggacagcaggattaaaagagccccttttctcaagggtaggaatgacttgaacttgttcgtggtgatattgaaaacctgaatgcacacaagaaggagaagctggggagagaaactgaagacacatggaaaaaatggactgtgtttgactgatggaactgaggccagaagaggtagactgagaaaatcaagagtcctatgtgggaacttgccagcgtctgcatttcagaggtcttcaagagcttcttctttctcttttctttctattttaaaagtttaatgttttttattatattcacgattcaaaaataaaaaattataaaaggcgaaacatttctttcttaccctgcatcttcccagtttccccttccacttcacccccttccagagtttctttttttttttgagacagagtctcactctgtcgcccaggctggagtgcagtggtgcgatctcagctcactgcaaccttcgcctctgggttcaagtgattcttgtgcctcagcctccctagtagctgggattacaggcgcccaccaccatacccacataatttttgtatttttatttatattttttaatttattttttaattatttatatttatttatttatttgagacagagtctcgctctgtcgcccaggctggaatgcagtggcgtgatctcggctcactgcaagctccatctcctgggttcacgccattctcctgcctcagcctcccaagtagctgggactacaggcgcccgctaccacgcccacctgattttttgtatttttaatagagacggggtttcaccatgttagccaggatggtctcgatctactgacctcgtgatctgcccacctcagcctcccaaagtgctgggattacaggcgggagccaccgcgcccagccaatttttgtatttttaatagagacggggttttgacatgttgggcaggctggtctcaaacttctgacctcaggtgatccgaccgccctggcctcccaaagtgctgggattacaggcatgagccaccgtgcccagcccagagtttctttatgcacatatattaaagtataaatataggttcttatttttactcccttcctttcccactccttttttaatccaaagacacatattaaatcccctttctgtaagttactttttgtcacttaacactatgtcttggagaatcttcccacatcattacatggagagctgcatgcttacaagcatttttctaatgctggcgtcataaatgcctgaagtttattatacatgtcttttcatttcacctgcttgaactgcatgctatttaataccacagtattccggcatttatttatttacttatttatttgagacagggtcttgttctgtcacccaggctggcatgcagtgtcaccatcatggatcactgcagccttgacctctgaggctcaagtgatcctcccacctcagcctcccgagtagctgggactacaggcacacaacatcatgcccagctaattatgtttatttttcatagagacacggtctcactgtgttgcccacgctggtcttgaactcctggcttcaagagatcctcctacctccacctcccaaaatgctcagattatagggataagccactgagctgggccgggcattccattttttgagtgcagcagggttgacaataattttcttgaaacattgaccagttcaggtcttgtctgattccaaattagctacatgaataacaaagatgtaaacaaacatcaaagatgatcactccacacgagcaggcaggtgctgtcacatctcaggacaaatgccctgtttggaggtagaatggagaaagtgtaaagggatctgtctttgggttaacagcaggaaatcagcagaacttcaaagctgataataatcagaagcttgggaacttgaaggactgttcccaagatggaacagcagattcaggtttaggcaacaggagaatgtcactatcagctaaaagcaactggaaaagtggatctccagaagtggagagctgagggaaaatcagaacaaatgtctcaaatctctctcaccccctttaattttcaaaaactataaattaaaacaataagatgacttgaagtgactgccttgaaatctaataagcagatgtattagctgcctttccagaaatgtttgggtggaaaaaaaattatttgaatcgaattttgtgctttgaataaatttaaaggattacacatcaattttagcctttgtaaaaacaatactgtgtaacaaatcactcacaattcagtggctttttaaaaatccaagctcggccgggcacggtggctcacgcctgttatcccagcactttgggaggccaaggcgggcagatcagttgaggtcaggaattcaagaccagcctatccaacacggtgaaaacccatctctactaaaaatacaaaaattagccgggcatggtggtacatgcctgtaatctcagctacttgggaggctgaggcggaagaattgcttgaacctgggaggcggagcttggagtgagccgagatcttgccaccgcactcccgtctgggcaacagagcgagactccgtctcaaaaataaaaataaaaactaaaaacccaacctaaacctccgatttggcaatgaattttagatacaacacaaaagcacaatccacaaaagaaaaaattgttaagctggacttccttaacagtaaaaacttataactaatcgtagtggctcatgcctgtaatcccagcacttgatctctcagaagcaagaggatcacttgagactaggagttcggcaccagcctcgccaacataacaagatccaatctctaccaaaaaaacaaaaacaagcaaacaaaaaactcttatcctctgcaaaagagtatgaaaacacaagccacagaccaggagaaaatatttgctgagcacctctctgataaaggatttgtatttaaaatatacatagaactcacaaaatttaataagatatgaaacaacccaatataaaaatgggcaaaagaaacgaacagatacatcaacaaagaagacacacagatgaaaaaaaaactatgaaaagatgctctacatcatatgtcattaaggaactgcaaattaaaacagtgagataccactacatacctattagaatggccaaaataacctacggccatgccaccctgaacattccccatcttgcctagaatggccaaaatccaaagcactgacaacaccaaatcctggaaaggatgggaaacggcaggaactcttatttattgctagtggagacacaaaatagtatagccactttggaagacagtttgatggctttttgttttgttttgagacagggtctcactctgttacccaagctaaagtgcagtggtgcgatcatggctcactgtagctgaaacctcccaggctcaagcaattctcccactcagcctcctgagtagctgggaccacaggtgtgcaccatcacatgtggctaatatttttttgagacagagtctcactctgttgcccaggctggaggacagtggcacgacctaggctcactgcaacctccacctccggggctcaagctattctcttgcctcagcctccctagtagctgggattgcaggtgcacaccaccacgcctggctaatttttatatttttagtagagacggtgtttcaccatgttggccaagctggtcttgaactcctgacctcaggtgatcagcccacctcagcctcccaaagtgctgggactacaatgagttagccaccgctcctgctcacacctggctaatttaaaatttttgtgtgtgtgtggagaagaggtctccttatgttgcccaggctggtctcaaactcctgggttcaagcaatcctcccacctttgcctcacaaagtgctagtattacaggtgtgagccagcacacctggctacagtttcttaacagatggaaaaatgaatccacacaaagggaaaaagagcatcaaaaatggcattggggccaggcgccatggctcacacctgtaatcccagcactctgggaggccaaggtggcctcggatcacctgaggtcaggagttcaagaccagtctggccaacatgatgaaaccctgtctctacaaaaaatataaaaagattagctaggcgtggtggcgtgtacctataagaccagctactcaggaggctgaggcaggaggattgcttgaaccagggaggcagaggttgcagtgagctgagatcacaccattgcactcaagtttgggaaacagagcacgactccatctccaaaaaaaaaaaaaaaatggcatcaattttcaacttgtgatgggggatttcctgattgtctctttccagaatatctttaaggtcaaaatattttcgtaataatactgatgttgttgccttttcactctcattctctcacaagcataagtggagttttccagtgtgatatgggaacagattgaatgcggaggcagacatgagaatctagctttcttctattcatccagatattcaacagatttgttaaaaatgtaaaacagccactcatctcacaaacattttctttctgaaaaagttatttttcatagacatgttatttctgttaatgtgtcctcttttattattgtttctaaaaatttatgttttaatctttcttttattttgagactaggtctcactctgttgctcaggctggagtacagtgcatgatcatagttcactctaactcgaactcctgggctcgagggattctcctgtctcagcttcctgagtagcgtggactacaggcatgtgccaccacactcagctaattaaatttttcgtagaaacagggtctcgctatgtggcctaggctgggctcaaactcctggcctcaaacaatcctcccacctcagcttcccagagctctgggattacagggtgagccactgcctgttttaatttcttttctttttttttttttttttttttttttgagacggagtctttctctgtcacccaggcaggagtgcagtggcgtgatctcggctcactgaaacctccgcctcccaggctcaagctattctcctgcctcagcctcccgagtagctgggattataggcaccacgtaccaccacactaggttaatttttgtatttttagtagagatggggtttcatcatgttggtcaggctggtctcgaaatcctgacctcgtgatccgcccacctcagccccccgaagtgccaggattaccggcatgagccaccacgcttagctgcctgttttaatttctaaccgcagcaaataatccacaccaacaggactctttggcattctcaataatttttaaaagtagttaaaaggtcctgagcccaaaacgtgtgagagttgttgttctagagtaactagcattgaaagttctttcacaaagctgactgcaaataaggaagatttggtgacacatagaaccaggtggtaaaaatacaggatgagggaagggctttcgaaatggaggcaaacagaataggatcagaaaatctgagctggagattagtacaaaagggaggagggactaaatcttttattgtgtctggggtgtagatcatttacctgctcactgtagactcgtgcctgacaaatataattgcctggcaacctcggctattagttgtttgagacagagatatgattgtagattctggctgtatgtaataataatacctcttaaattgcatctggcacttagggacgctgtctaaatcccttgtggcatcattattcatagttgccttctgtgttcattttacttataaagaaattgaaaactcagaaaagagtgtgtggctttggatttaggtagccccggattaaaaatcctgcctaatgctggcttcatccgctgtgtgagaaggtaaccatttcaagcctgcactgctgaaggaagcaccagtgttctggcaacacctcctgtgtcctgactttggctttggttctcacagtgtggtttcctctgttctttcccaccgtttgagcctgattctccagcttttccagtaagtcttggggccactgaaacttttacaataaattcattttctttttacagcaatgaatgagggttccaatttctccatgtcctcatgaacacttgttattaaccatctttttttattatagtcatgcattgcataatgacattttggtaaatgatggacctcacatatgatggtggtcccataagactataatggagctgaaaatttcctattgcctagtgatgtcatagccatcataatgtggtagtgcaatacattactcacgtgtttgtggggatgctggtgtaaacaaacctgtgctcccagtcatataaaagtgtaacacgtgctgagcgctgtggctcacacctgtaatcctagcactttgggaggccgaggcaggcggatcacctgaggtcaggagttcgagaccagcctggaccaacatggcgaaaccccgtctctactaacctacaaaaattagcctggcatggtggtgggcccctgtaatcccagttactcgggaggctgaagcagggagaactgcttgaacccaggaggcggaggttgcagtgagccaagatggcgccactgcactccaatctgggcaacagagagagactctgtctcaaaaaaaaaaaagtgtaacacataaattatgtatagtacataacacttgataataaatgactatgtttctggtttatgtatttgctatcctatactttttatcattattttagactgtactcctgctacttatatattttttaaaattaactgtggaacagcctcaggcaggtcctacaggaggtattccggaagaagtcattcttatcatgggagatgacagctccatggatgtttttgcccctgaagaccttccagtgggacaagatgtggaggtggaagacagtgacactgatgatcccggccctgggtaggcctaggctaatgtgtgcgtttgtgtctttgtttttaacaaaaaaactttaaaagtttaaacaattgaaaataaaaagagaaaaaagcttacagaataaggatataaagaaagaaaataggccgggggcagtggctcacgcctgtaatcccagcactttgggaggccgaggcaggcggatcacaaggtcaggagttcaagaccagcctgaccaacatggtgaaaccccgactgtactaaaaatacaaaaattagccaggcgtggtggtgcacgtctgtaatcccagctacttgggaggctgaggcaagagaatcgcttgaacctgggaggtggaggtcgtagtgagccaagatcatgcttctgcactccagcctgggtgacagagagagagactccatctcaaaaaaaaaaagaaaatatttttgtacgatagtacaatgtctttgtgtcttaagctaagtgttattacaagagtcaaaaacacttaaaaattttttaagtttataaaataaaagctacagtaagctaaggttaattcattattgaacaaagatagttctttataaatttaatatagcctaaatgtacagtgtttataacgtctacaggagtagtgtacggtgatgtcctaggccttcacattcactcaccgctcactcactgatacccacagcaacttccagtcctgcaggctccattcacggcaagtgccccatataagtgtactattttttatcttttataccatatttttattgtatctcttctatgtctagacccacaaatactgaccattgtgttacaattgcctatggtattcagtacagtaacatgaggtacaggcttgtagcctaaaagcaataggctctaccgtatagcctaggtgtgtagtaggttacagtaggtttgtgtaagtgcacttgataatgttcacaagacaaaatcaccaaatgactcatttttctcaatgtatccccatcgttaagcgatgcataactgtatggtcattctagtcagggttgatttccaccatttgcagctaagataactgtggctaatctcaaaatcaattgaataataaatgtttcatggaaagccctcatatataatccttcaactttcaagtttagggattacttttgacttatatgaagacagaccaacaagaagtcagtattgtataagcccagaaggcaaggacacttgcccataagccatagagaactttctacacttttggaaaggatagctcctaaaaatacatgtgcccaacttccaagtgtcaacactcgcacatctttgcctgaaggctctctctggttctgaaatctttacacaaatcaggccacaagctccagggaatcaaatatatccccagagcattcttcaaaccaatgatggttagaagatggtagataaatactccagctccctccacccccaggcaggataaaaattttttaaaaatattttgtccctcttatttttattaagatataattcacataccataaagctcatacttttaaggtgtacaattcagtggtttttagtatattaactaaaaatagctgcgcaaccatcaccactgtttaatttcagttcattttcatcactccaaacaaaaattctgtacttattagcagtaattccccattccaccctcccaccagctgctagcaaacattaatctattttccatctctatggatttgcctattctggaaattttatataaattttatataaaacatattgtatggagtcatataatatgtgggcttttatgactggcttctgtcacttaacataatgttttcaagatttattcatgttgtaccatatatcaataatctatttctttttattgctgaaatctatttcattgcatggatataccacattttgtttaaccactcatcagttgatggacacttggattttttttccgcttttggctattctgaataatgctgctgtgaatattcatgtacgagtttcatgcgaatatttttttcaatcttcttgggtatgtaacaactgggagtggagtttctgggtcataggataactctatgtttaactttttaagaactggaaaactgttttccaaggcagttatgccagttttcattcataccagcaatgaatgagagttctaattccttcacattctcactaacatttgttattatcgtctttttaattgtggttatcctggtgggtgtgacatatctcattgtggttttgatttgtgtttccctaatgatgaatgatgttgaacatcttttcttgtacttactggccatttgtatatcttcttgggaaaaatatctattcaaatctttacccattactgttggggtctgtctggcaggataattttgagttgtacattctacactgtctgccagagttctccagtgggattaggatctatttgctcacactggtgacttgattgataacacatcttttatctgtgctctcccttccatactagtttgctaagactgctataacaaagtaatacagactaggtggcttaaaccacagaaaggtattgtctcacagttctggaagctggaagtgtgaaattaagacatcagtagagttggtttcttctgagggctgtgagggaaggaactgttccatgtctctcatttagcttctggtagttgttttctggcaatctatgtcattccttagcaagtagagagagtaggaggaatgatgttcgccaaaattatgtagattgggtagggatgccatctaaaattctggataaaaattggccacttcactattcacctcctccaatgcccaccacacatacctctgaagagttagaattttggacttccccaaacattccaagctctcacatatccttatgcctttgctcaggctatttttgggcaaccattcacaaatctcattcttcctttaagttccagctcaatgtcactccttatttaagtcattcccaaatgagtctaatcatagtaaattccagaacctgtgtggaagctataagtccagataggctaccaccacgtgaagcctgagaatgaagccaacatgaagaaggacagagaagagagattgagagaagccaaattctggggacatcatttgaattgaatctctgggttaaactacaccaacccgtgccgatcccttgatagttctgtgtcacgtgccacagtatcatatgtctcgatagttccgtgtcaagtgtagagacaacaggattgccttaggaatatattctaaactcatatagagtctgctttttttttgagatggagtcttgggccgggcgtggctcacgcctgtaatcccagcactttgggaggccgaggcaggcagattacctgaggctgggagttcgagaccagcctgaccaacatggagaaaccctgtctctactaaaaacacaaaattagccgggcattgtggcacatgcctgtaatcccagctacttgagaggctgaggcgggagaatggcgtgaacccgggaagcggagcttgcagtgagccgagatagcgccactgtactccagcctgggcgtcagagtgagactccacctcaaaaaaaaaaaaaaaaaaaaagacggagtctcactctgttgtccaggctggagtgcaatggcacgatctcagctcactacaacctctgtctcccgggttcaagtaattctcctgcctcaggctcccaagtagctgggatcacaggcacccaccaacatgcctggttaatatttgcattttcagtaaagacagggtttcactatgttagccagactggtctcgagctcctgacctcaggcgatctgcccgccttggcctctcaaagtgctgggattacaggtgtgagccactgcacccggccactttccatagagtctgctatgccttggtttgtagtggcttcatcacgtatcttgcaaaaaaactaagacaagattgtctaaattctctaggtcagtttcctatggctgctgtgacaaatatctacttgtggcttaaaataacacaaatgtatcatcttatagttctggaggtcagaagtctaaaatacatctcacagggctaaaatcaaggtgtcagccaggtcgatttctggaggctctagaggagaatctgtttcctttccttttccagatgctacaggctgccgcctcctctggctcatggcccccttcctccatcttcaaaaccagtacaagcatcaatccaacttctgcttccatcctcacatctcctcagactctcttgcctctctcgcctctctctttcacttataaggactcttgccattacagtgaccccatctggataatccaagatatctccccatctcaagattcttcacttttttacatctgcacaaatccttttgccaggtaaggtaacatattcataggttctggggattcaaaagcagacatctttgggaggggaggcattattcggcctctgcctcttcatagattttatttttcttgctgtcttacttattgtcatatttgaccatttctaaaattctggcattctttcaattagttataccttccttctttcctcccttcctttattggacaacctcatctgagcacctactatgggctaagtgctatgcaaggtactgcagggatacaattatgtatccagactctaccctcaaggtatttacagtcagtgcatttcctcgatggccctgttactggtcttaattaaaatgagctaacctttgggaaaggacattgcaaacactgcaggtgcaaaaggtagtagaaagctaataacaaagagagtggtccaagatttgaagtcctggttttcacaaagtatagataggactgactttccctaagtgggcactgacactgtgaagaccggtcacaccctcacccaaaggctgtcactgtggacttcaccatcacctccaacctcactccccacccctccaagaagtgcagctttctgcaaaacatttgagccactttttttttggcaaatttcccacagatcagtctcaagaaatgcttgacaaaacacttggtccctaaagagtcttatcttttacaagtacatactgaaatatttacggatgaaatgatatgatgtcagggatttgcttcagaacaaaatgtgtgggaggaagtgggtgggatatcgatgaaacaagactgaccatgagttaataattgttgaagctgggtaatggaacacaggggcttattatactattctagttttttttctttgcatgtttaaaattttccataataaaaaaagttggcagggcgcagtggctcatgcctgtaatcccaacactttggtaggctgaggcgggtggatcacctgaggtcaggagtttgagaccagcctggccaacatggtgaaatgctgtctctactacaaatacaaaaataagctgggcatggtggctcatgcctgtagtgccagctacttgagaggccgaggcatgagaatcacttgaacccgggaggcagaggtttcagtgagccgagatcacgccactgcaccccagcctgggcaacagagtaagactccgtctcaaaaaaaaaaataagtaaataaaaaataaaattacaaatttaaaaggttaaggaggaaaattttgtcactatattttacctatgtcattgtcataagcttatcatttgaatatattttactgtataaatattcgcctagattttaaaaataaataagcacaggtatataaatatttgacaaagcagttatcttctacaaccacttgaatcacagcagggaagagaaagtgctagatatcttgcctgcggctagccttggaacaataatggtcctgtcctcagagaagaaacacatgaaactctcaaacttcattccagtaactggacttaaagggttaaacataccatatggggaaagatagtttaacttgattaagagataactgtggctctttatgatggaaatggtgaactggcttgacccatctcagattttcgtatattaacttccaggtagcatgttagcattagcttgggatcatgaaactatggttttcagcctcagtgtgaatctgagaaaaacaactgaaatgaatagaattttctttggaacttctttatctgcattttcagtacttgtgtaggggaaagagctcaagcattagagccaaaaattgaacttgacttccatctcagacctcaggcaggttccataacctccccaaacccgtttcctcatctataaaatataaaataatgtctactttgcatggatgctgtgagggttatgggtaatgtatataaaatggctctcccaccacagacaactaatgagagcttagtgtgtttataattgcatgttcctctttacccctccccacatctcccatacagtacttggcaacagtaagaatctaaaaatgtttgctgaattaaattaaaccctaattagatggtagatagatggagttagtgggaggaagtgttaagactacagcaggctcagctgggcgcaatggctcatgcctataatcccagcactttgggaggccaaagtaggtggatcacctgaggtcaggagttcaagaccagcctggccaacgtggtgaaaccccgtctctactaaaaatacaaaaactagccaggcatggtgtgcacccataatcccagctatttgggaggctgaggcaggagaatgaatcatttgaacccaggaggtggaggctgcagtgagctgagattgtgccactgcactgcaacctgggcaacagagcgagagcgagacactgtctcaaaaaaaaaaaaaaaaaagctgtaccaaaatccgcccttggcacatgacttgttcacatgagagcttcatctcccacttcctgtccctcacatctaatcaattaccaagttctatctattcaagctcccagcatcactagaatctactcacttcccttagatcctgctgctaccaccttagttcaagattcatctctctcacccggtctatagcaaaggctggtcccctcaatctgttctcgccccctacagtcctttctcttcactgtagctggagggatttttttttcctttttttaattatgaaaaatttaaaacattcacaaaaattgagaatataatgaacacccatgtactcatcacccagcttcattcaattatcaatgaatggccaattttgtttcacatataccccacccactctccccaacgttcttggattattggaagcaaattccagaagccatcgcattggaaggggagtcttttcatggattcagaataaaactcaaaatccttcacagggcttgccaggtccttgatctctgctgacttctccaactacagattctagcttgctattccccagactgagacctaggcaagccagccttccctcagttccttcaacattcatgttgcttctttcggtccctgcggccttcaggctgctttcaatgcccagaaagcctgttatcatcttctttcaccctgtttgctgggctttagctgctcatgtctttgctatcactttgaatatcaccttctcaagaggcccccagctcaggctaggtgtccccttgctctcttggcaccttctgcttctcctgaaattatcaatacataattttgtagttaatcatgtaaagctgccgtccctgttaaaaattagctctatggcataggaaccatgtctgttttgtaccctgctgaagcaccccgtgcacagctccataccttctgtataggaggcacctaataaatatgtgttgaatgacatccccaagaaaggtaaatacaaaagccacatgcatttcacattataaattgcttatatacttagaccagtgtcttaaacctgttataaccacaagaaaaatgcccaggcctttaattttaggtgtattttgttacagtcaatacgactttttaaaaagattctgagctgcatattatgctagacactgaaggttcaaagataaataatacactgcaaaatgataaaaaactacaacaaacttagtttaaagagctcagttgactttatgtgagagtctgtaattgggcaacactccattccataaaacagagtaagtgttccgataagctgagcagatgaggttggctttatagacaaagaaggacggaagaaagcacaagcaaagaatgaaaattgcattgatcctttcaaagccacttttcttgtaaggtggggacaggaagacagaataatagaaaaataactgattagttaatattaggttacttcaggctacttctgttgtacaaaggttaaagcagagatttaaccgggcctgtatgagaaactggctgttatctctcctgatttctcggaaggtcagacaacaacctagtttggatttggtgatgtggaactttatcaaagttaactccattctgatttttagtctggtctgttggagcctagtgcagaaacttagcccaaaacaatagccccccgtaatttttatttaactacacagatcctgccctcaagagttgcgtctagagataaagacagccatttaatgctgtgataattggtcatttctcatactatatgtagaaggcagaatatttcattagccagggaatctgtaaagtgtcaaacaactagaaataagcaaaaatttgccataaaacaacagctaacatttactgggtccttctttttggccaagtacggtgaaagcatttttcacatatgatttcattgaattcttacaacatcctttgagacttaccttatgcttcctattttacagatggaaaaagtctaccaacacgttgaaaatttaggtaacactttctaagttacccaggagttgaaaccagggagtctgaccccaagggtatactcttaccctctatgctggggttaacaagcaatcttcgagtactgctgcaagaaaaaaataaaacaaaggacactttttaattaatcactgcttcccacttcatgtcctggtttcatagttatgtgtgtacactttcataggaaaatagcagatgttgtgaaacctgttactgataaggctaggttcctatgggtccaaggcactaaccattgaatttggactttgtaccaaatatttcctatagagagaaataagctagaaactctcaaggtgtgaagctactgcctaccttgaacctagcctgtcttcttggccagactgaaagctctgcattcttttcttcttgtgcagtacaccttgttggcttacctcctacagatgggatctagtcaagaggaaattcattatattttaaaacggataaattgttcagatgagttacatgcttggaacttaaaccatggcaaaaaaaattctgtattaattatgcatatttgggagtttgctttttaacttttaattaagggaaatttccatcatatgcaaaaatagaccatgtaatataatcaacccccacgtactcttcaccctgcttcacacagacactttttcgtggatccatattgcctcctctgtcttaactaagccattgctggatgaaaagaaaccctagagcagcattgtttaatgtgagccagatatgtaattttaccttttctagtcaccacatttgaaaagtaagaagaaacaagtgaaataaactgtaaccgtacattgtatttaacctaatatattaaaaatatgatcattccagtactatcaatataaaagttattatcgagatattttatattttttcttttgtactaagtctttgaaatgcggtgtacattttgcaattacagcatattacaatctggacgggcttaatattttaagggcttagtagccatatgtgatataagttaaatacactagtttgtgattagtggctaccatattgaacagaacagccctaaagcgcctagggtaagagagtaaggactaagctctgatttttctcttgtccaaattcctatctaaggagcctggggagtcatgccctacaaaccataaattctcatcagatggggtttatttaaccctgtatattgtgacttactttccaatctgactctagcataacaagaaagaaaatcgaaatattttaccccaaaacatgtttctctgccatatcttgaaatggccctgaaaagccatcccttatgggaaaaatccacattctatagagaatcccctttctactttgttttccttcctttttttccagatccaggagataatcaactaagagccaggtacccttttaggtcctattcgaaacattttacaacctgctctctctgcagtctgctaagttggtctccacaaccctttatcttaacttaaacatttcttttctggtgatgccaggtcttcagataaactcaaccaacagtcaaccagaaaatgtttaaatttacctacagcccggaagcaacccccgccccgccccactttgagttgtcctgcttttccaaaccaaaccaatgtgtttcttaaatgttttctattgatgtctcatacttccctaaaacatataaaaccaggctgtacccccaccaccttgggcacatgttctcaggacctcctgagggctgtgtcacaggccatggccactcatatttggctcagaataaatctcttagaatattttacagagtttgactcttttcatcgacaggagtaaacagctattttgcaatttacccgaaaataatgctactaaagacttctggcaaaagttgaagtacagtgcatatatactgggcttctccatgaaatcgccaacaaaagaagaccaacaacaataattaaaaagttactcgggaggctgaggcaggagaatcgcttgaacccaggaggcagaggttgcagtgagctgagatcgcgccactgcactccagcctggacgacagagcgagactccgtctcaaaaaaaaaaaaaaaaaaaaaagttagacaagtccttctacaaaaaaggacaacctccaaaccccagactatgatgaaatgtggctctccagatcttgagcaaggttatagtgagtagaaagtatgttagcatttcctgagaggttacaacgtggtagagtacagtggctctagacacgcaatacctggttctgctatttacaagctgtgtgacttgagcaagttattcaatttctctgtgcctcaggttcctcgtctataaaaatgagcatcataaagtctgggatagttttaaggactgaatgaggaatacatgtaaaaacatgcatggcccatgttaaccttccataaatgatcaccattcaaaacaaaaaaaaaccaaacccaacagcaacacaactgtggggagaccaaaaggaaaatgagaactgaggatgaggaaggtggggctgatgatacaattgaattcattagtaatttttctctgtgctctggattctaacttaacaaaggtgcttggagacgggagtaagaagagagaagaaatcaaaaccggctttgctggtgctgaccagtccattaagcagagttaaacataaaatccctagacaaaatatctcttatctaggaatctttttttttttttgagacagagtttcactcttgttgcacaggccggagtacaatggcacgatcttggctcactgcagcctctgcttcctaggttcaagcgattctcctgcctcagcctcccaagtagctgggattacagacgtgagccaccatgcccagctaatttttgtatttttagtagaaatggggtttcaccatgttggccaagctggtctcgaactcctgacctcaagctctctacccaccttggcctcccaaagtgctgggattacaggcgtgagccaccacacctggcctattatctaggaatctttacagttgtccacaacaacctcctacttggacagcttgctcaactgaagggaaattgtcctactgaaaaaaaaaaaaaaagacaacataatttggggagagtgttctaaggcagcattttcattttgaagttgtcagctactccagctcaataaactgaccctctccaaactgtttttcaacaaaagaacaaaagaaccagatacaattgtttgcatgtagatatgagataaacacagaaaagaaatgcaatttaagttgtatgcatagtacagtttttaaaagtgacacacagaagaatatttaagaaaaagatttcactctcaaagaatttaaaaggaacctataaaatctttgccaaaggggctgtgagcggtggctcacgcctgtaatcccagcactttgggaggctgaggcgggtggatcacttgaggtcaggagttcaagaccagcctggccaacatggtgaaaccctttctttactaaaaatacaaaaaaattatctgggtgtagtggcacatgcctgtaatcccagctactcaggaggctaaggcaggagagtagcttgaacctgggaggcggaggttgcagtgagccgagatcatgccactgcactccagcctgggcaatagagcaagatcctgtctcaaaaagaaaaaaaaaaaaaaaagattatttgccaaagagcttcagaaggaagtatgagagatcagagaggaagatgaagtaatcggcttcagtaaggaaaaaaatgatacataacattaaagtattttggaaatgaaaatcacaatagaagcagtaagaagcatagaaatgctgaaaaaagaatccatgacttggaaaacagggttaagaaaaatatagagggcagagataaaagaaaagagagtggttatccataatatggaagaacaatgtattagattatgatagaataatatataatatagatagatatgaggaaaaacagtactcaggaaatatggcactgatcaacccctcttggaaaagttacttgcaaaatctagacaatcaagagacagttcaagataaagaattcaagaatggaaaagactttgctttaatggattgttagtgagtactgaccccatttaaatatcaagaggttactggaaaggggtcctgatccagactcctaaagggttcctggatctcatgaagaaagaatttggggttagtccatagagtaaagtgaaagcaagtttactagagaagtaaagaaacaaaagaatggctattccatagacggagcagccctgagggctgctggttggctatttttatggttatctcttgattatatgctaaacaagtggtggattattcatgagctttccaggaaaggggcaggtaattcctggaactgagggttcctccccgttttagaccatatggggtagcttctggacattgccatggcatttgtaaactgtcatggcactgttgggagtgtcttttagcaggcaaatgtattataatttatgtataatgagcaatgaggatgatcagatgtcactttcatcaccatcttggttttggtgggttttggccatcttctttaccacatcctgttatcctgttgagatacaggttgttatgacctgtatctcgtgacttcctatctcatcctgtgactatgaatgcctgacctcgtggaaatgcagcccagtggtctcagcctcattttacccagcccctattcaagatggagttgctctggtttgaactcccctgacaaaactgaggtaaacaatagcaagaattacaaactgcagagcagaatgagttgcagggttgacactgtcaatgtaaacacagtcaggtagtctaggagggcatgctaggcctctgggccaacagtcaccaacagtggggccttcactggagcagccaccaaagcatggctcagcattgctcccctctgcagaggcaagcctggctctctgtttcttccagagattctgtgggcttccttgttaaaaagaatttttctgtagattctgttttactatggattctgttgtttgtcattaagactctgactgataaaccattcaaatgaaatttaagaaaggccaggcacagtggttcatgcctgtaagcctggcatttatggagactgaggtgggagaattgcttgaggctagaagtttgagaccagcctggccaacacagtaagaccccatcttttaaaaaaaaattaagaaagatgtatgtggtcaaagtgttaagtgtatggatgcttatacacagttggtaggaatggtgtcccaacctttgaaacggcaatttggtggtatcaattaagatattaaacatgaatctcagtgacccagaaattctacttctaaaggaaattatcttacatatttaaagtcattttcatttgttcaacgaatatgtattaaacactgtgctacatgctggagaccctgcaataagcaaaacaagccaaaattcctaccttcatgaggcttacattctggatggaagagtggagggcagatagacaatgaggaaagtaaaatataatatacagtatgtcagaagatgagaagcgctatttcgaaggagaaagcaaggaaaggatgtaggaggtattagacaatttttaatttgcgatcagtggtcagggaagactcatatgtaagtaaagacctgaaggaggtggggaattaagtaacataatatttgaaagaagagaattccaaaaagaagaaacagcaagtgcaaaggccctaaggcaaaagcctaccaaacatattagaacaattgccaaggaaactagtgtggctggagaagagtgaagattggagtatggaaggagatggttcagagaataatggcactgggggtagacattgtagctttgctggccgttgtaaggactttggtttttaactctgaatgagtgagaagccattaatttttaatgttgttgttgttttgagacagagtcttgttctgtcacccaggctggagtgcagtgacacactcatggctcactgcagcctcagcctcttgggttcaagcaatcctcccacctcagcctcccaagtagctgagtctacaggcacgtaccactctgcctggctaatttttatattttctgtagagacagggtttcaccatgttgctggtcttgaactcctgggctcaagcgatccacccgcctcagcctcccaaagtgctgggattacaagtttgagctactgcgcccagccacattgaaaggttttaagcagagagaaaagagagaaatattaacatattaaaatgcgctgcattgtgaatgggttgaagaagggcaaggcgaacacagaaggcatttaggaggctattccagttatccagtcaagagatggatggcgacttggacctggggggaaaacaatggagtggggataagtggttagattacacgaagaggcaaaagtgcaaagacaaacacgttcaagagatgttgtttataactgagagaaactagacataacctaaatatccaataatagaagaccagttaaacatatgatatatccatttttttttttttacttaaaagcttctgtagtgattgaaagcatgtgttaatttttaaattaaaaagccaagtgaataacattaatttttaatgttactcaacttcaacaaaagcatgttttgggaccattaaaatatcttgtttggcaattaaaaatacaaacctagaagcactgacatgaaagtttcttatttcaaaaacaattatgaggggccaggcacagcagctcacacctgtaatctcagcactttgggaggctgaggcaggtgaatcacctgaggtcaggagttcaagaccagcctggtcaacatggcaaaacctcgtctctactaaaaataaaaaaaaaacttaggcaggatggcggcgggcgcttgtaatcccagctactctggaggctgaggcagaagaatcgcttgaaaccaggaagcagaggttgcagtgagccaagatcacgccactgcactccattgtgggcaacagagcaagactccatctcaaaaaacaaaaaacaaaaaaaacgaaaaaacaataattatgagccaaatagaaatatgcacctgtacctcttaaactagtgtaccagtaataattcgtgactagacataacaaagcatatacttctattcttttcctttgaaacatttttgataggacagatatagtttaggaaatgcagaaacaagatgcgagtcaaatagtggtttttaatgaaattttagattgagtttgctgtgacaaagcatctaagatccgaataggcaaaaagatttgtctaagaggtgaaaccaggacattaatatgtgattcacaacctacaaattggtcagggaacaatttggtggaggctggaaattggtagataagaatgatctcaatgatcctttattagtcactcgccaaatgccaggcattatgtcttcttgtttttacaacttctcattttagaatacataccttaattccacaaacttgcccattagtcattggctagtataaatggaaggtctgaaactcgaacttgggttgtcttatgtcaaagcacatccttttcctgctataacgccctgtattaagtaaggttggctagattgacttttaaggttgttaactgaaaaaaatcacacgatttataaatttagaaaagattggccaggcacagtggctcacgcctgtaatctcagcactttgggaggctgaggtgggcggatcatgaggtcaggagatcgagaccatcctggctaacacagtgaaaccccgtctctactaaataaaatacaaaaaataaaattagccaggcatggtggcgggcgcctgtagtcccagctacttgggaggatgaggcaggagaacagtgtgaacccgggaggcggagcttgcagtgagctgagatcgcgccactgcactccagcctgggcaacagagcaagactccatctcaaaaaaaaaaaaaattagaaacggtgaaggagactttttttttttttttaaggattacagccttcaaggcgaccactgtgcaggctgggaagcatgcctctggccaagatcagagacaggcactttgaaggaggagagattaaaataaagctcctcaaagggttggttaaacatacatattcaacaggttacaggaggagctatgaattgccaagaccggctcggtcagggagaccctaacccagcagtgctagagtaattaaagacacacacacagaaatatagaggtgtggagtgggaaatcaggggtctcacagccttcagagctgctgagagcttcgaacagagatttacccacatatttattgacagcaagccagtgataagcattgtttctacagactgtagattaactaaaagtattccttatgggaaataaagggatgggccgaaataaagggatgggtttggctagttgtctgcagcaagagcatgttcttaaggcacagatggctcatgctattgtttgtggtttaagaacgcctttaagccgttttccgccctgggtgggccaggtgttccttgccctcattctggtaaacccacaaccttccagtgtgggcatcatggccatcatgaacatgttacagtgctgcagagattttgtttatggccagttttggggccagtttatgaccagattttggagggcctgttcccaacaatgaatattcatggtagtcctgatgcacacgtactgaacaaacatgcatgtaacatacattcattttggagtggatacttaacattgaaatgtattacaattcggacacacacatcaaagtatcttttcaggatacaaaaaagagcacgacctctgtaaaccaactagaaccagtccatggtcagtggtcttattaagagaaagttactgaaatcagtctcttgtccaatcaaagctgtggttttacggctgatgggacaggggctgaggatcaattagcatctgacggagccgcaaatagttttaatattgcttatctcaaggtcagtgcttgtttagctgctacagaaaaagaaaacccttataattgtgaaccccaaaaatccgagacaggtctcagttaatttagaaagttcattttgccaagactgaggatgcatgcctgcccacgacccagactcaggaggtcctcaccacatgtgccctagggggtcagagcacagtttggttttatacattttagggagacatgagacgacatcagtcaacacatgtaagatgaacattggctcggtctggaacggcaggacaacttgaagcagggaggatgtcaggcctctgagcccaagctaagccgtcatatccccagtgacctgcacgtatacatccagacggccttaagcaactgaagatccacgaaagaagtgaaaatagccttaactgatgacattccaccattgtgatttattgctgccccaacctgactgatcaatgtactttgtaatctcccccacccttaagaaggttctttgtaattctccccacccttgagaatgtactttgtgagatccacccctgcccgcaaaacattgctcctaactccaccgactatcccaaaacctgtaagaactaatgataatccaccatcctttgctgactcctttttcggactcagcccacctgcacccaggtaaataaacagccttgtcgctcacacaaagcctgtttggtggtctcttcacacagatacctgagaaagaggaggcttcctggtcataggtagagaagaaacaaatgattgcattcttttgagtttctgattagcctctgattaggctctttcatttatactagccagtgactaatgggtgactttgaatagaatgggaggcaggtttgccctaagcagttcccagcttgacttttccttttagcttagtgatttgggggcctcaagatattttcctttcacataatatagttagaacacaggcctatgtcctgtttataatgtggtatcttattgccacaaagagtctattctgtcagccttatgatctctattttaacattaatgctggtcagttgtgtctaaaccataaaagggaggggtataatgagatgtggttgacctcccatcttgtcatggccaggaactcagtttaaggcttttctggggtccccttggccaagagaggttcttttcagtcggtggggggcttaggattttatttttaggtgacaaggcttttctttgggaacaatagtatatctagtgggattatattcaattccatggaacaaaccctgaccttaaacaagtaagggggttgcttttctcgtgtagtaagacatctggagctaggcacagctaggtgggtgcggctccacctttattgtgggctgtcccagagtctaagactactgctccacctccagcctcaaggcaacctcacagcaacctcaaagcaggaaggaaacaggaggctgagaaaaggggtagtacccgcaacaggaaagcaaaaaccttcccaggacttgccagctgacgtcctcctatatctcaatggccagaattgtgtcacgggaccatttcctcctacatctcattggccagaaccatgtcatgtgatcacccctgcgatgacctcgcgaaagtgggcatcttagcttggcacattgcctccctgtacaaaatctgggttctcttagaagttaagaaggcgagaatggatttgaggaggcagttagcagtgccccgtaaagaactgacggatcagggatgtcgggagaggagaagccgcctcggaagtaccactggactctggatttctaggagctctgggcaccactgttgatgcattttgctacaaggaggcagggaaagatagtctttgttccacgaagctctgggcttagcttcagttctattacagccccttaatgacagggatacattctgagaaatgcgtctttaggcaatttcattttgtgaacatggagtgtacttacacaaacttagatggtatagcctactacacacctaagttatatggtatagcctattgcttctaggctgcaaacttccacagcatgtgactgtactgaatactgtaggcaactgtactgaatactgtagacaacggtaagaatttatgtctctaaacatagaagaggcacagtaaaaatacaatataaaagataaaaacggtatacccgtatagagcacttaccatgaatggagcttgcagggctggaagttgctgtgggtgagtgaatgaaaaggcctaggatattactgtccactaccgcagactttataaacactacatttaggctacactaacaataagttaatcttggcttactgtaacttttttactttgtaaactttaaatttttttttaactttttgactcttttgtaataatacgccttaaaacacaaatacgtttcagctgtacaaaaatattttcttctattcttattctataagcttatttttcccattttgaaaatgcatttatttaccttttaaactttttttcttaaaaacaaaggtgcaggcctacacagggtcagtatcatcaagatatcactaggtgataggaatttgtcagctccattctaaccttgtgaggccactgttgtagatgtgatccattgttaaccagaatgtcattgcagcacatgactttattacagaagaaggaaagaatggacagtggggagcaaccaaggtctctgtctgccacagttcctccaccagcccctgagacagagttcccctcaggaggagtctggtatgcggacccatgtacacatcatctctagacagagagacttcagggcagttgttgacatcggcttaagaaatggtgggagagtggcaggcacttggggatgctgaaagtatttgaagataaatccagcctcccagatccgcctggagagaggcattgacagggcagcctggctgctcagagctaccctaccccagccttgtcactagcaatatgtctctccttcctgggtctcagtctcattttcctcttcttttttttttttttttttttttttgagacagagtctcgctcttgtcgcccaggctggagtgcaatggtgtgatctcagctcactgcaacctccgcttcccaggttcaagtgattctcctgcctcagcttcctgagtagctgggattacaggcgcccgccaccatgcctggctaatttttgtatttttagtagagacggggtttcaccatgttggccaggctggtctcaaacttctgacctcatgcagtctgcccacctcagcctcccaaagtgctgagattacaggtgtgagccactgtgcccggctctcattttcctcttctataaaggagagtaataaccctaccttgcagggttggcgtgaggctcgtttgaagttatgtatgtccagctcctgttctatactatccactccctagatgatggttatttttgttatgagtatgatttggcccccatgccctctgctctaactcaactcccatcctctccctctcaggtcttctgacccacttgccattcccttattagaacatgaactctctgcctggctttccacttcccactttgcacacgttggaatcttggcggaagcacctcacatcccgttgaacccggtactcctctgtgattcagttggcctctgcacttctccaggaagttctctctgccactccaggccaggtgaagctgctcctcagtctccctagcaacccacacttaattctatcagggttcttcttgcacccttgggcaattactgagttccttgcaaggctagtccagactctcagtgtataaaccacccttgaggtaactaattccatcttagaaaaaccctccattttatatttcatgggcactttgctaacaaggataagatgttttgcttgacgaacaaattttaaaaaagaacacaaacaagcacactcatccactataagttctcaccagaggaccctctgactgtaaaagagcgaagccttcagcttggctgtcttcactaacaccgtcttgcagtcactcatgataagaactcagaatttgccaccgaaagctctgccacatcaaagactcttccttgcaagaccaccaggcccagaccaggactccctttgtcttcttccctccctttggactggttcattaaccctttctcctcttcttcgtcttgatgttaaatattactttgttgtggaatgtttaatctacaacattcgtatagtgattaagtatactagtatgtatggtttgcaatatttactgacttatggagtggcttgaacctatgtgctctgactacagagtgaatgggaaggactaaggagaattgcctccttgggaactccatgtagctcctggattttgtgattgaaatagcatttaaaaaaaaaaaaagactgacattgtggagagatacaaacgtgtatggacatggtcatctttaatctctaactgctatgacactcagagaggttgagaggctcaggacactccccttgttcaaggctctgcgtgaagaggagaaggaagaaattgtgcaatattttattttattttatttgtttcagatgaagtctgtctctgttgcccaggctggagtgtaatggcgtgatcttggttcactgcaacctctgcctcctgggttcaagtcattctcctgcctcagcctcccaagtagctgggactacaggcatgtgccattacgcccaactaatttttgtatttttagtagaggcagggtttcaccatgttggccaggctggtcttgaactcgtgacctcaagtgatccacccgcctcggcctcccaaagtgctgggattacaggcttgagccactgcgctggcctaattgttcgatattttaaatgtttaaatgaccggcaagtcgtaggtgctcaacaaatatttgttgaatgacaacaaattagcactgttgacacaaaaaaggcaatgcaatatatgggctatttaatatttgcagatttttatttaaaaatctgaattcacagtacactgcaggcggttgcttagaagcatacaagtttcaagaagttctgtcaccctgtgtatactcttttttttttttttttttttttttttttttttttttgatacggagtcttgctgttgctgcccaggctggagtgcagtggtgcggtcttagctcactgcaacctccgcctcctgggttcaagcgattctcgtgcctcagcttcccaaatagctgggattacaggtgcgtgccaccaagcccggctaatttttgtatttttagtagacatggggaccaacgtggaccatgttggccaggctggtctcaaactcctgacctcaagtgatccgcccaccttgacctcccaaagtgctaggattacaggcatgagccaccgcctggccaccctgtgtaaactcttatctggagacaactgccaagtttacatttgcagaggtaagggaaggagaggccctgacccagtggcccccgctcgcccgcctgctggggagatggggagctcctaggacaggggccgggtcctcaagatgtggcatgaggaagggggtctcactgagcccccaagcggctcccgcactgcgcacccctggctgcgtccctctgccagcctcaactcagccctctcctagccggcggggggtgacagtctctgtgatatctttccgtcccgccggcaggcggcgccctccggcccttgtttcgttgggcccggacgggacgtgcgcgctcaaaggttgcccgtctctgacgcccgcatttcctggtctggagccggctgagccacagcagggtcgccgcggggtcccggggccgtgctcccctgcccctcccgggagcgcgcggggcggggcggggcggggcgggaccaggcgggcgagctgggccctcgcccctccctcgggcggtcacctgggcacgggcgctgcaggtgtcggggcctcaaccttgcggagccgacagccatcgatcctcgggtgagtgcgggcgcaggtggagggcgcccggcgctctcgccaccggcgtcccagcctcggggcggcgaacggtccccgcgccgctcccagcctccctggccgggcgttcagcgcgcctgggaggggaaggaatttcctttgcaggaactcaggggctgggggttctctgctacttaagagatccaggagtggagcccggacgcccgagccttcctgcttcgggatggggattaccgcggagccttagcaactggggtctgtcgtgggtttgagggcagggggtctggggaatgggcgtgtcccgcacccagagactcgccaccctctctccaggggagatgctttttaaacatgacaaacccagcaaggttatagaaatgggtgtatgcaactcttcgctctttcctggcgcccagaggtgaatagtctcacacacacgcgcgcgcgcgcgcgtgcgtgcattcattggggccgactttgcctcccctcccctggcctcgagcgttggggacggcgcccccgcccgcgcccgccactgggattaagccccagggccttgcccggctatttgttttccgaggccgttgcgtccgggtaggttcctggatgaccatcctggctggctcaaaattccctctagattacctgcgaccacccccaggaacccggagactgaaactccttttctcacctgcgcaggtggcctcgaggtggtggcagggccgccccctgcagtccggagacgaacgcacggaccgggcctccggaggcaggttcggctggaaggaaccgctctcgcttcgtcctacacttgcgcaaatgtctccggtaaggggaagtgtcgcttaaatcccagagataacccccaccgagaagcatcacaaaagacatgaacgagtgtttagctctcaggattgttattgcttcgagtgaaatggtttcttgtgtgcttttgtgcatttatatataaatataaacatatatgtatacatttgacaagctctaagaccggcacttgtgatatctccagaatagagttattatagttatttggaaattgtcagtgaggatcagcttggttgctatgcgaattgcagggaggaggacctgtgtgcagtttcaaaacgatttaagagaaattcggtggcaatacaaggtgtggacgttggttggatcctgatttgatgaatgttttttaaaatggagatgatgcccgagtgcggtggctcacacctgtaatcccagcactttgggaggccgaggtgggtggatcacctgaggtcaggggttcgagaccagcctggccaacatggtgaaacccttctctactaaaaatacaaaaattagctgggtgtggtgacacgcgcctgtaatcccggctactcgggaaggctgaggtaggagaatcgcttgaacccgggaggcggaggttgcagtaagccgagatggcgccactgcactccagcctgggaggcagagcgagactccgtctcaaaataaataaataaataaggagacgatgaaggacatttctactgattatttgatggtatcaaggaaattataatagttctgtttagttacttttggtaacggtatcctgattaaggtttttaaaatccctgtagagacacagactgaagttgaaatacagctttgggatttgcttcagaattattcagttttagatgctagcagagaagggaggggaacaagatgagaggagattgttcatggattgttaatagttgaagctgggaagaacacatggacacaggcaggggaacttcaggcacgggggcctgtcggagggtggggggaaaggggagggagagcactaggacaaatacctaatgcatgcagggcttaaaacctagatgacgggttgataggtgcagcaaaacaccatggcacatgtatacctattaacaaacctgcacattcagcacctgtatcccagaacttaaagtaaaacaaaaataaaaatagttgaagctggatgatggttatggaagtccttatgctattgtttcagtatttgtgtgtgtttggcattttcctttaaacagaacaccaccacttgtggagcttttttgcataaggtaggtttggcactgcagccgagtctagatgcaaggtcttccgcagacgctcgttctttgtaaattgggtgtcaaggctgcttctccagactcggtcataaaaagtttttttctccctactggaggtgccgatttattttgctcagaaggcagagggtgtttgctgagtgtgacaaagctgagcggatcaagttgatgcaggtggaggctaggtcagctttttttacacaaagggcattagcaagcctgggggttgattgcctccggtcgggcggattgtataaaacgtgttagcagtttttcctaattgcccaaatcccttccaagttgtgttcatcaaaaaacagagtttgcagtagtgaacacacgtgtcggtatgcacttaggatttatgtacacttctgaaagcattgcatgcctcagtaaaaagtgtatatgatgaaaacaaagcacaagatgagtagagggctgcttattgcttgagagagagcttagctgtgttgtgttgcctatttcatctttatcttgtttgcttcagcgatcatgacatgtaaatatttagcaaagcactgactcctaaaagttctgcatggtggtaacacattttttttaagaatcatgcttgaaagagggtaaggaaggagtaatagctatatcttcatcaggcttgctccagatttcttttctccagatttagcctataattcctactcattctgtcatgcttggtcagtactttggaatagtgattctgagagggagctgttgaagttagtagagggaggaaggggaggtatatttccaaaaggtaaatccacattttttagtcgcttcagtataactgaatgtaatgccttttgatttaaagataaaacaagtcaaagagatgagatctgggacagttaaaagttgaagtgttcggtgaatctccccggcgtagaccttgctcgtgtagattcactagtctaaaggatgtaaagatttttttttttttttttttttgagacggagtcttgctctgtcacccaggctggagtgcagtggcgtgatctcggctcactgcaagctccacctcccgggttcacgccattctcctgcctcagcctcccgagcagctgggactacaggcgcccgccaccacgcccggctaatttttagtagagacggggtttcaccgtggtctccatctgttgacctcgtgatctgcccgcctcagcctcccaaagtgttgggattacaggcgtgagccatcgcgcccggccgtaaagatgttttaagattcggttgaggaatgctgaagcatgtcctaatttcactgctgtgatgggaaaataatgagacaaccaacaaaaatccccttacagtggggggagataccacagtgaattcatgatggttcttaaatgaagtgaaattgtttggtttgtggctctgttttcttggtatgaatgaaagaagtatgcaaccgtcacgtaactttattttatacctcagtttcctctctagttccctaaaagcatggaaagagaaaagaaacttgccaggccctttagtgaccaaactaatgtttactctcctctgtaggagagtggtagatttggactctggagagttgattgctaatagccattttaaggacttaccacaaatgtgacaccatttcgccctgattcacattattaagggtatgaacgcattagaaaagcaaatggctcccttgttgggctagaaatgataggaaagagtgttggcaatctagtcaacagtattctcctagattcataaacacttcgctttcatctgcatcacctcatcccatcctgtgaggcgaagcagtggtgatagagggcaattttggtttttaacagatgggaacattgaaatataaggaaatcagcctgggcaacatagtgagaccttgactccacaaaaaataaagataaataaataaaaattagccaggtatggtggtgcacgcctgtagtcccagctactcaggaggttgaggtgggaggattgcttgagcctgggaggttgaggctgcagtgagccgtgatcataccactgtactccagcctgggtgacagagcaagatactgcctcaaaaaaaaaaaaaaaagaaagaaagaaatctaaagaagattgctttaaatcacatctttagggagacagggaaggaaatttaacatttatcaagagttcattggccaaagaaaagagttcatgggctgggtgtggtggctcgcatctgtaatcccagctctttgggaggctgaggggaggaaggtttgcttgaggccaagagttcaagaccagcctgggcaacatagtgaggcccccatctctacaaaaaaaaaaaataaataaataataataataataataaaattggccagtgtggtggtggctgaggtggggagggtggcttgagcccagcagttctaggctgcagtaagctatgtttgcaccattgcacaccagcctggacgatagggcaagactctctctcttaaaaaaaaaaaaaaaaaaaaagaattcatggtagtcttctggtagtcttcacacactttttttttttttttgagatggagtctcgctctgccacccaggctggagtgcaatggtgcaatctcagctcactgcaagctctgcctcccggattcatgccattctcctgcctcagcctccccagtagctgggactacaggtgcccaccaccacgcccagctaattttttatatttttagtagagacggggtttcgccatgttagccaggatggtctcgatctactgacctcgtgatctgcccgcctcagcctcccaaagtgctgggattacagacattcacacacatttttgttttttgttttgttttgttttgagacagagtttttgctttgttgcccaggctggagtgcaatggtgtgatctcagctcactgcaacctctgcctcctgggttcaagcagttctcctgcctcagccttccacgtagctgggattacaggtgccagacaccatgcctggctaatttttgtatatttagtagagacaaggtttcaccatgttggccaggctggtctcggaactctcgacctcaggtgatccaccctcctcggcctcccaaaatgctgggattaaggtgtgatccaccatgcctggcccacacacgtttttaattctgacaaatgtctctaggttgggtattatcagtccattttgcaaatggaagttgtagctagaggttaatagtttttgcctgaggtcttgcagctagattcaaactcagctctgtcagatttgacagtctgcgttatttctggcagtttcacactacctttagcaggaagcagagcaatacgcccaagaattgggtagtctaggcaaactatcttcttatcacaccccactgtcctggtgacaggcggggggcatgggtcacatctgaccaacagatgttctgtcgggccagcatagagcttaaaaaaaaacactgagtgagcgttgaaaattgggaaatgtcaaatattctgccctaacgattcccaacggcaatactagagcagctgcctctttagggaagggtagtacatcccagtcccctcagcccccagcaacccctaaaatagtccccagccctgagattgtacttttttttttttttaacggtaagagatctttctatgtatgtgtctctaccccaaatggaataacaaaatataggttgagaggctcttgttgcaagaaaaatgggaaagacactttgggaggccaaggtgcggggatcacctgaggttgggagttcgaaaccaacctgaccaacatggagaaacctcgtctctactaaaaatacaaaattagcctggcgtggtggtgtatgcctgtaatcccagctacttgggagactgaggctggagaatcacttgaactcagggggcggaggttgcggtgagccgagatcacgccattgcactccagcctggggaagaagagcgaaactccatctcaaaaaaaaaaaaaaagagaagagaaaaatgggaaagagcatattcctttgaggaaatgagagtcttgtgtttagtctcagtgcttctctgtcagacgaatacaagccgcgttgtcatttttctcccatgctgcctattttctcacttataaggaacttgttcgctaccccctgcagtttgacaagaatggagtaggtgtgggcaggcctcagtagggaaaaggaatggctccaaactcccacaccattgggtctttgtgagtaggcaggtgggtcttgtgcaccttggcggttccccagggtgtcctgcagggatggggcaccaaaaaggcctttaacccttcccctttaagcaggggacccatgtggatcctgaagttgtgcatcagctcactgtagctgctctgagctggaccccagccactctgaggggttcctaggacttgcaaagggcccctctcccccatccttctctgcctaccactctcctgctgatgacaagtccacttctatacactgcttaggcacagccccccaagaaagctctgcagggatgaggagctgaggcacccgcatagtccagccttaaggggtttctgtgatgcaagtccaagggtggcttaatttccttgccttgaaactttcggttaagggtcacggggcaaacattctcgcttctgtgaatagctggagtttcatgacagttgaagtttctctttagatctttgtttccttcccctgagttctgcattttcttcccatgtacgtgtgccgtggaggagaatgaaaagaggaaatggcacaaaagtgaaccttgttgggtggctttcaggaaatgtcaggtgctgttgtgggcctttgtcactcgagttgtcagtctaggtgtgtgtgtaaacggacatggaataaacaagggctccaagtggaacagcttgttttggccaaaagaagtgagttcaggccgagcatggtggctcacacctgtaatcccagcactttgggaggccgaggtgggtggatagtgaggtcaggaaatcgagaccatcctggctaacacggtgaaaccctgtctctactaaaaatacaaaaaaaaaaaaaaaaaaaaaaaaaaaaaaaaaaaaaaaccaattagccaggggtggtggcactcgcctgtagtcccagctactcgggaggagactcgcttgaaccaggaggtggaggttgcagtgagccgagatcacgccactgcactctagcctgggcgacagagcaagattctgtctcaaaaaaaataaaaaataaaaaaagaaagaaaaaaaaagaagtgagttcagaggctgacatgttttgtgaatgccagaccagcggcttgatgggatcctttctggagaactctgcgattcaggtttgtggctgtgtgctccctcaggtgatgattaacccccttgtcaaggaagagtgggttaattggttattagccagagcaaacagggagaggccaagcagtcttgagtatggactcagccagatccctgggtttcatttctggttcttccaccacctgtgtgaccttgactcattttttaaaacctctttgtacctcagtttcccctatgtaagctagaagtaataataatacctacatcatagggcggtgaggattcagtggcacgtcaagtgcttgtaacagtgcctggcatggagtaggatggattgtgagttagctattattattgttgttgttagagccctgcttcctttactttcacttttactggggagaatttcccccacataatgttagaagaaagaccacagggaagaaatgcatctgagctctgacctctgttcgtggagtgagccatgggctgcccatctgggttcccacatggccttagggaaatgttctccatgacaaatgctaacagggtgtttggtgcagcagcagctttggaattgatgagaactgggccacaacttgtgactttgagccagggctttggctttgttgttcggggattaaaatctccactgactgtggaaaggagttggaatcccctagcattcatgtggatacaaactccaaccccttatgagagagcgggctagtgttagctgggacacaggagtcccagcctcagctatgccaccgcctggcaggggtttaaggccaggtcttctgggcagccagtgcctcttctgtcacctggggataagcatatctaataggaatgttgtgaggggctaacaacattttatgaaatcctgacacagacacagcaaagtacaatgcctgacttgccccttagtagtaaaatcatagaacagatacattgagaggcttactttttaacttggaaaagtaatatagatgctgttaactaatgtttatttaatattttatagttcctaaaagggctatctggtttgatctttaaactagcaatgcaggtttctgtttgtttacatttgtttcgattgcctttggctgcctgtttcaggagaggaggtacagaagtgaacccaggttcaggccagaaatgagaacatggaatggccttcattttactgtatcagagaggtaacatgagttcttattctttatgcccttaagtaattctgaggaggaagcactttagagattgatagctaaggtgttgctgggaagctgaaagcatccatggtgtccagggaagctgaatggagggccagtgattcccctccaagcagcagggcagaggtctcccctgtcgacagcccttgcctggtccccttcagcagggggcagtgggaggaagagaggcagtaggctttggattctccctcctgccccaggtgcagacccaaagcttcagagtccatcctaccttcacctaacccttcgtccttctcctgcactccagccaggtgtttcagtgtgtagtctgtacctgccacaccctcaccgcatccccccaagcctgcactgtcctgttcaccgcaaggttttctcttcttcctatggcctcagctactttccattgctgcccttgcctcctgatcctgcctgccttcaactttactgtattctgaaaggtttaaagggaaaagtcttttatgacccacaatccaaggatctgaaggcattgacatttgggtatatttcctttttattttgttttactttgtttttttataaatttaaaaaattttaacattttataaacaattcattttatgttagaattttaacatagttgctatactttgattaaaatttatcattatgacgatatcaaaaagacacctgcatgcatatgtttatcatagcacaattcacaattgcaaagatatggaatcaacctaagtgtccatcaaccaatgagtggataaagaatatgtgatatatgtatatacacatcacatatacacatacatatatacacatcacatatacacatacacaacacaccatggaatactgctcagctataaaaagaacaaaataatgtcttttgcagcaacttggatggaactgaaggacattattcttttttttttttttttttttgagatgaagtcttgctcagtcacccaagctggaatgcagtggcccaatgtcggctcactgcaacctccacctcccaggttcaagcgattctcccacctcagcctcccgagtagctgggattgcaggcatcagccatcatgtccaggtaatttttgtagcgacagggtttcaccacgttggccaggctggtctcgaactcctgacctcaggtgatccacccgccttggcctcccaaagtgctgggattacaggcgtgagccaccatgcccatgaaggccattattctaagtgaagtaactcaggaatcgaaaacgaaatgccatatgttctcacttgtaagtaagtggaagctaagctatgggtacacagaggcatgcagagtgatataatggactatggagactcagaagggcaggatgggaaggggatgagggatgaaaaacaacctattaggtacaatgtacactacctgggtgatgagtactctaaaatcctagactttaccactgtacagttcatctatgtaaccaaaacccacttgtacacctaaagctattaaaaaattttttttaaataaaaaatcattgtattcccctatgtctttataaatgtttttaatgactgcatgctattttaggcttttttagccattcttttaaaatattagagaactaagttgttgctcattttttgatgttgtacatcattccaatttgaatgcacataaaccttggatcccatttcacattatttgagatggattcctgtaaaaataagtactgagtcaaaggttttcaacattggaaagttttctttcttatcacaaaagcaacagatttgtattgtggaagatacaggacagtgtaaaaagtaaacatgtacctctattctcaccaaccagttgctgtttgtgtcgccgggttctccccctccaggacaaatgtcctcttcaggcttgctccatgcgtggcctgtcggctggcagcatggcatcacctgggagcttgttagaaatgcaaaagctcaggcctgccccagacattgaatcagaatctgtcttttaacaagatctatattcaagtttcggaagtcttagtccctgaggccaccaccttaccagtcacggtgggctggcattaattacctctgatctgtgaatatacgtacatttttcctatttccctgatactgggatgtaccactgtgtctaccactggtttgcaccctcctgtctcccttaacgtaagaccgtgtaaggacaagagcaggctcccctcagtaacaccggttcagggatcagcaggatctcatctcatccccctatgagaagccctgctacacacagctttatcttgtatctgtcatttaacattatattgtcagcattttcctgttatttagtttttctctcaagtttatctttcatggctgcaggtggtaatccatcttatgactgtctgataattcatttgactcattccctattgttagacattaagttgttttgattcttttggggactggggagggtatactgtgggctattataagtatgccaaagtgaactgcttccgcagtaattatttccctcaacccagattatttccttatgacaagttaccagagtgcagacactgggtcaaaaggcatgaacgttttaaaccctccttaaaatgccgcaggagtatacaaagtgccctgacatggtgccctcccagacactgggtagtgtggtctgtagacagactccagggagcagggtcatgcctcattcgcatcacgcctccagggctggtgtagagccaactctgagggtcactctaaggggacctgggggaatggaaaggaagtgacggaaggatgggcaagctgcctgtggtggtggtgctcctttcctcctggcctgagtcctgagtcacagtagatgtcactgaccaggcagcagccttcctcagggtgtgtccacaaagtttagcctttcctcccggcacccgtcttccagtggcttgggagctggagcaggtggtggaggcctgaaatgactacttggtgagtctggaatgtgccggacctgattgctgccaagcttgtttttgcttcacgagtctgagactgttgggttctctaatacttttttcctctcaccagcagaccaggaacctgatattaagtaaactttattctaaaaggtacactcagacaattccttttttttttttttgacactgagtttcactcttgttgaccaggctggagtgcaatggtgcgttctcggctcactgcaacctccacctcccaggtttaagtgattctcctgcctcagcctctcgagtagctgggattacaggtgcctgccaccatgcccgcctaatttacttcttcttctttttttttttgttgttgttgagatggagtttcgctcttgttgcccaggctggagtgcactggtgcgatctcagctcactgcaacctccacctcccaggttcaagtgattctcctgccttggcctcccgggtagctgggattacaggcacctgccaccatgcttagctaatttttttttttttttgagacggagttttgctcttgttgtccaggctggagtacaatggtgcaatctgctcaccataacctccacctgccaggttcaagtaattctcctgcctcagcctcccaagcagctgggattacaggcatgcaccaccacgcccacctaatttttttgttggtcaggctggtctctctgccagtatacaatcagttcccacctgtagccccagatagccattgaacttctttctgtctcttgccttgtctgggaaatttcaaataagaggaatcttgggatatgtagttttatgtgtcaggcatctctcacttagcacaacatttttgaggttcatccatgttgcagcatgtatcagtagtttgttcctttgtattgctgagtagcatacagttttataaatgtactgcattttatttatccactcaccagttgatgaacatttgaattgttcccagggcttggctattatgaataatgttgctataaacgaggtaatgttgctatctacaagtgttagtatggaccttatttgtatttctcttgagtagatttgtaggggtataattgcggagtcatgtggtaagtttatgtttaactttttaagaaactgccaaactattttccaaaagcggctgtgcaatgttagagtcccactaacagtgtatgaggattctctacattcttgccaacatttgaaattgttagtcgttcttattatagatattccaaagggtatataatggtgtctcattggcagttttaatttgcatttccctaatgactaatgctgttgagttccttttcatgtgcttattagttacttatatgtcttcttttttattggatatttgatctatattgatatcaatatagatctatatcatctttgatgacacgtctagttacatcttttgccccattttaaaactggattatttctcaccatcctcttattgaggttcaagaattttaaggtatatatctggatgcaaattctttatcaaatatatggtttggggctgggtgcagtggctcacacctgtaatctcagcactttgggaggccaaggccagcagatcacctgagatcaggagttcaagatcagcctggccaacatggcgaaaccccgcctctactaaaaatacaaaaattagctgggcgcggtggcatgcgcctgtaatcccagctactcaggaggctgaggcacaagaattacttgaacctgggaggcggaggttgcagtgacccaggatcgtaccactgcactccagcttgggagagagaacgaaactctgtctcaaaaaataaaaaaataaaaaacaaataaatagtttgaaaatattttccccagacccatgactttttccctaatggtgccttttaaagaaaaaaaaagttttaaattttgatgaagcctaagttgttgatttcttttatggtttgtgtttttaatcttatatctaataagtacttgctgaaccttatacaagtcttgtggacatgttttgttatgtttttgagatggagtctcactctgtcacccaggctggagtgcagtggcgcattctcggctcactgcaacctccacctcccaggctccagtgattcccctgcctcagcctcctaagtagctgggattacaggtgcacgccaccatgctcagctaatttttgtatttttaggagagacgtggtttcaccatgtcgaccaggttgatctcgaactcctgacctcaagtgatccgcccaccttggccttccaaagtactgggattataggcgtgagcctctgcacttggccgacctgttttaattactcctaggtaaatatctagtagtagaagtactggatcataggataagcctatgttgaaatgccacactattttccaaggggatacaccattttacacctcaaacagcagcgtataggagttctcgttactctacatcttttccaatatttggtattgttggtctttctgattttagtcattctgatggatgtgaaattgtatgtcattgtcattttaattagctttatcctgataactaatgatgttgagtacctttttgtttgctattggccatttgtacatattctttttggagtgtctttttaagtattttgcccatttttgtttgagtagtttgactttttgttattcatttgtaggcactctttatatatgtggtctggtagtctgggcacaagtcttttgttagatagatgtgttgtaagcattttctcccagtctgtaattgccttttcattttcttatgatgaacagaagaatctaattttaatgagttcactttatcaattttttttctatttggtgctttttgtgttttgcttgagaattctttactctaaggttgcaaacatattctcctttgttttccttgtagagtcttaccttttatagctatgcttgtgatctctcctgagttaatttctgttaatggtgtgaagtggagttaaggtcctttttttttcatacggttatccagttagtccagcacagtgtgttgaaaagactttcctttcctccattgaattgcattggtactttcttataaatcaagtggactggtttgaactcttaagctcattgtcttgagttctataatttataagtcttgaaatcaggtagtgtaagtcgtccaactttgttattggctattctaaccctttgtattttcatatatattttagcatcagcttgtgaatatctttaaaaaagaaaaaggcctggttggattttgatcagaactacattgaatcaactaatctggggaggattgacatgttaataatattaatcttcttatccatgaacatggcatatctctgttaaggtctttaggtttttttggcagtgttttgtagcttttagcattgacattttataaatatttatacaaatttattcttattttatgtttttgagtctattggaaatgatatattttccttcatttttgaattttgttgctatatatagcaatgtggttttaaaaattgacctgtgatcttaactaaattcatttattaattccagtagattttttgtaagtaccttaggattatcaatatacataaatgccatctacaaatagttttatcttatcctttctagtctgtatgcctttcttttattttctcgccttactgaatgggctaggatatcctaaaatgttgagtagatgtagtaaggacagatatccttaccttgtttccaattttaggggtaaagtggtcagtctttcacacttaagtataatgatagctatagatttttcatagatgttccttatcaggttgaggaaaccatcagtttcctactttgctgagaggtttttatcatgaatggttgttgaattttttccaaagatttttctgcatctctcaagatggtcatatgcttgttttctgtattcagtaatgtgaatatatttatttttcatctgttggcactttctcttcacctcaaattagggaaaagaccacagttacccattttggttttttgtttttttttttaattactcagctttaacacttgaatatcttggcatttgtgcatggaatattagttcaggaacatgatttagacaatttgaatcagacaatttccataaaatattttataaactaaaaagcagcgtttgtgtgtgtgtgtgtgtatgtgtgtgtagagttatttggcttgagagccctgcctgcccaacaaacttatcttaaactctcatcattattagtctcatgcttaaaaaaaaaaaagtatcatttaagtgaagacttcaggcagttgagggagcaagctacatgagtataagaaagaagaccatcccaggcagaatggtcttctgaagcacaagttcaaaggccctgaggtcccagaggtatccagaaaactgtctcttcaaaattgcttttgcctgacattgaagcagacagcaggggctaagaaaacatcaccaccttctggcagaatagaaggactgagctgctcaggtcaaatcattatagtaaaatatacctaaaatttaccatcttaaccatttttaagtgtacaggtcaatggcactaagtacattcacattgttgagcaactgatactgctatctacgcatcttcagaactttttcatcctgtgctgaaaacctgcacccattaaacagtaactcctcattcttcccttctcctagctcctggctactgtttactttttgtctatgaatttgattattctaggtacctcatatatatgggatcatatgatatttgtcatcttctgtctgcttattcacttagtgtaatgtcttacgggttcttccaccttcagcatgtatcagaatttcttttcttttttttttttttgagacgaagtcttgctctgtcacccggggtggaatgcagtggcccgatcttggctcactgcaacctctgcctcccaaattcaagtgattctcctgcctcagcctccctagtagctgggattaccgccatctgctaccatgcccagctactttttgtatttttagtagagacagggtttcaccatgttggccaggctggtctcgaactcctgaccacaggtgacccatctgccttggcctcccaaagtattgggattataggcataagccaccgtgcccggccaggatttcatttccttttaagactgaataatattctactgtatggatataaagtcgttcttaggagatgtgtatgttatatttctgaatcctgagaatggaaacaaaacaggtagaatggtagtggggcaagctggcgtaggtctgggatactgttaccaaagacttataggagaactggaccccggctgattgggtcctgacatcacacctgacaatgtgatggtgaaaaaaggatctcccttaggtggttgttctggttcagtttctcagcaatgatgaataaccgtggtttcagaaaccatgaacaactaagcatgaagaatgtcataacctctctggtggttgagtcatacaaggagccacattcagaagcccgggatggagagtggggtctcagggactattgagcacagatttctgattgctactttccagatcattgtatgcttaggccgtttattttgatgaagaaagcaagactaaaggacatgataatcattgagaaccaggaggcaatctctagttcagatgttcttttaaaaactttttttttttttgagacggagtctcgctctgtcccccaggctggagtgcagtggcgcgatcccggctcactgtaagctccgcctcccgggttcacgccattctcctgcctcagcctcctgagtagctgggactgcaggtgtctgccacaacgcctgtctaattttttgtatttttagtagaggcggggtttcaccgtgttagccaggatggtctcgatctcctcacttcgtgatccgcccatctcggcctcccaaagtgctgggattacaggcgtgagccactgcgcccggccttaaaaactctttttaaacctcttctgtgagcatgtttgctaagcggtcagcccataagtatctgaacaactgttcttataatcctttgttgctcttattaatcccattcctatattgttgattttttttaagatatattttctatttgttgatgttgttcttaaaactcagtacctgaatgactagtacaaggtatgcaactcctttctctttaattctgaaccttatacttgtattacttatctgttcccaccaaaatgatgacgaggtgaatatatgtgtagaatttgcagtcaataaaatacagtcacattgtaagggaagtttatgtgaaaatatacatcaccagaatactaatttacaagcaaacataaggcattgagtaaaaattcatggtagctttatagaaaaatgaattgtgtcagtgtaacctgatttgttttcaagaacattttacggatctggaggaagcaggggacataatcttaactttctcatgctattgatttcattatgaatgacataatcaataacagcccggggaaacaggttagctcacatgataccacagttagacggtgggaaggtaacacagagacattatcaaggatatggttccagtgtgggataagtcatcatttaaccttttagaggtcagtctgggaaccattctgtttaatcagttttaatccataactggtggcatattagtgtatatgtttgtatgcgagaaatactagaaacagaagtcaaaataacctgcattaatggggtaccgtatttataaaatactggacagaatcacgtgaaggctaattaattttgtaagtaagaggttcaaattggagaatgattggcactgtgcctatttttggcagaaaaagcctatgggccatggtgaatcacaaggtagttgaaccatcacagtaactataatgtgggtatatgcagaataccacatttcatacatcagtgctctagttaatacttgtatgagactgaaagtaggcaaatgatacagtgaagtcatttcataactggcaataccaagacttctcagaactatgtttagcttgagtgcatactatgtaaagagggtcttacaaaatgtataccggagccacaggagagcaaaacaattatttaagtgatgacatctggtcaagatggcacaggagttcaggctccaaacacctagcaaaggtagttataatataaaaagggtaaccaaataagtatagttgggctatagtcattctagttacctagaatgtaagttgaaatacaaaggggtaagcaggctcaagctgcaggcctctccagcaggggcaaccagaaactcaggttttttagaataaggggatatagctttgtgcagtggccatttcatagccagtgaagtttatctgaggcacttgctaattgaaaacttttctcaataccctgccatgatgaaatatggttggcactggcaatttttgagactctatggagactgaacttaacattaaaaacaaattaaaaaatgaaaagatagggatgtaaaagtatccacatgagctgataccaaggagttggagccaggctccagggaatgtaaattgggagaataactaagtttcttccatacctctaagaaacattggcaacactgaaatcagagactgcagtgccctccctcccaaacctaagaaggaaggctggaaaagatggcttacctggaaggaatgggcttctggaagtttcagagacaaagacacagcttcagaaccagaagctgagccatgctgctttcttggcccagggcctggatccgcagtatcgctgataccacaactgagcaggaacaccaagtggcattttgagacctggtttggaagaagtcctgagaggccaggtggagggactgaaagctgcctgggaagggagagaggagggaaagatacagcaatcgaaaactcctactgaaagtaagcttgcaaagcaaaactttaaaatacatgaagacatagatatggagttcaaaatttgttcaagcaagacacgaatttactaaaagtgaaattagcagttggaattcctggaaatgacaataaagtaagtatgtttagaattcttacgatgaatgaagtcttgcagtagataaaaattatgaagtagaagcaagggggagggataggaaaaagaaccagttagaacagttttgtattaagtcaagtgggctaaaatgctttaaaaagaccaaaaatgcaatggatcaaatccagtacgagcttacttctctcgtgtagcaggcctgggtgggtatttcaggccactgggtggctgtaccctcagggacccagctgacggcacccatatgggtttcagaattgccctgctttcccacaggaagtgggtgggtggggaataagctaggccagaaatggtcttcctcatgtctgctcacgccccaccggccatacctaacttctggggagcctgggaaacaggtcagccacgtgcctgggaaaaagaagggaagataaaatggagaataagtttctgccatacctctaagaaacagtggttacattgacaacagatttctcatcagcaatagaattgaaaacacaagagagtattatcttcaacttagaattcaatactagttaaaccgtcattcaaaaatgatgatcagcagtccctatgaaggaaaaattggcaatatctaacaaaattatgtaagcattcaccctttgacctaatggcctcacttctagtaattattccagaggaaacacctccacaaaatagcaaagaatatgtacagaaggttgttcatcgctacattatttgcagatagaacaaatttggaaacaacctttatgtccactcatagaactctggctgaataagctatagtatatctacataatgcagccataaaaacaatttttaaaaaattaaaaaggaagatagctattaacaaagatgaaatgctttctaggatgttttaaggggcaataaagagtcacaaaaagtatatctaatgtgctaccttgtatttaagatggaaagggaaataaccacacatgtacacacacacatgcacaaacacacacacacacacacacacacacacacttatttttgcagaaagatgcacaggaactataaaccagaaataaatgatagggggtgggtggatattagtggaggaaataagtatggaaatgagacttttctgagcgtacctttttatatagttttgattttgagccatgtaaatattttacatattcaattatataaaattaaaatgaactaaaaataatgaaaacaaaggaaatcctgtcattgaatatacaaagagaaactaataatcaaaacactatatcaaattgattacataaatacaaagaagagaattcagataactttataacagagtactcagactgtataagcttagtggaatatagtcaagggacaaaaagaatggaaaaaattaggctttatttacctggttaattgttgggcaatgctatcagtgtagtaactctgaaactgcttaatatgtattgtagtttgaacaaatgaatcaatatactaatgtcattgggaaccaggttcttttttgttgttaatttcttcattgaaattctgtattcaatcacaggagttggagtctgcttcctgctgggacccttcctgatcctttaagttaatctctaatttgctattagtgtggcttcctgcccttttttttcttcagcttttaagttcaggggtacatgtgcaggatggggaggtttgttacacagggaaacgggtgccatggtggtttgctgtacagattatcccatcacctaggcattaagcccagcatccattagctgtttttcctgatgcttttcttccccccactcccccctctagcaggcccaagtgtgtggtgtttcccaccatgtgtccacgtgggaaccagattcttgctgtgggagatgatctttcaagtatgtatttcactatttcacaaatactgaaataaggtgaggaagactcctgagatggtagctttgcattggaggtatcagtgtgccacccagattctagttttaaaataccatattttcctaaaaaaaacagggctccttgaaaaaaaatgaccagaagtacaacgtgccaaagcgggcatgtgctcagcaactgggatggcaaaagatacatatgggagccagcctgaaggaaccctgacaagatgatttggaaaattttaagcattcaaaagaagaatgatggcagtgaattataacacatttaataaaaataaatcaatgaatctataatgtatttccagaaacaactgccagctcatgaaagcagaatgaatcttagaattagaaaattactattttacaactcccagtgtggtgattaattcaggcaaggataataaacggatgctaaaactatcaggtgaaactttgttatgcaacggattggtctaacagtctcaaagtattaattacaaagggaaaaggtcctctacaacagtaaaatggacgaggcgaggtggctcatgcctataatcccaccactttgggaggcctaggagggataattgcttgaggctaggagttcaagaccagcctgggcaacagcaagaccccatctctacaaaacagtattttaaaaaaaaattaactgggcatggtggtgcacacctctatagtcctagctactcaggaggctgcggtgggaagatcacttgagcccaggagttctaggttacagtgagctatgactgtactactgcactccagcttcagcaacacagtgagaccctgtctcaaaataatactaataataaaaagaaaaagaaatatggcaaacacctccttaatcaagtgacctaacatcacatgaccagtaatgagacatgacataatgggatatatcatctagatagttttcttgccagaaatgtttaatattgagaaaacaattagacaaatcgagattatgtgatattttacaagataactgacctggactcttcaaaaatgtcagtattgccgggcacggtggctcacacctgtaatcccagcactttgggaggcccaggagggtggattgcttgaagtcaggagttcaagaccagcctgaccaacatggtgaaaccacatctctactaataatacaaaaattagccaggcgtggtggcaggcacctgtaatcccagctactcgggaggctgaggcaggagaatcgcttgaacctgggaggcagaggttgcagtgagccgatatggcgccactgcactccagcctgggtgacagagtgagactctgtctcaaaaaaaaaaaaaagaaagataaaaaacaacaacaacaacaaattatccaaaattaaaagagactaacaagacatgacaaatatgtgatccttgattggattttgtattaaaaaaaactctaacaacattgggacagttttaatatggactatgtattagatactataccatttaatttaatttcattaaattaatatttatgggacagttttaattaatgggacagttttaatatggactatgtattaaatactatataatttgatttcatagataaaatgatggtatcatagttatgaaaatggctatccgattataagataaatcatcataggaaaaatgggaaaatatcgagataaaatgaagtcttataagaccacactaagataaccatcattaacactttggtatatttccatctcatctacatatatttaaacaaaattgaattgtactctacatggttttttatgttccttctgcttgttccatattataattattggcaagtctccattaaatagtcctcaaagatattcttttaaatggttatatactatctctgtacattttcttatttttaaatttcaaggccatgcgcagtggctcctgcctggaatcccagcactttgggaggcggaggtgggagcatcgcttgaggccggcagtttgagaccagcctgggcaacatagggagaccccatctctatgattttaaaataaataaataaaaattaaattccaagtttttttattttataaggtctattttacaatattttattcaatcaacatgccatccattgtaagacatcattattttatgtgtcactaaaaagaaaattttcctgaggtgggtgtgtcgggccctactgggcctagcggcaggagggggacatcggctcccaccacagccctccaaacagctctgcgctctgagcgccccctccccagggtccccctctccaggcaggaagatgtccaagtcccgtgcggcggaggcagcagcgggggtgacagcgacggccccgagcccgcagatagtggagcagaggggtccagggaggcgctgcaccgacgttggggagaatgtatgtcctggcaatcaaagatcttttcctccgtgagcctaacaaatgctctggaatgtgttccagccttcaggaggagaactccgttacacgtcacgaagtcaaatgccaggggaaaccattagctggaatccacaggaaaagaatgcaacacggagcacgaagcccaagcacagaagatcaaagacgccaggagaggacccctcgcaccttttccaaaccaaaaatgtgaagcagcagaacttccaaaacctccggcctcgtcttgtgattccaccaatgcagccatcgccaagcaagccttgaaatagcccatcaagggcaaacaggcccccgaaaaaaagctcaaggaaaagtcgcaaactcacggatttctaccctgtcccaaggagctccaggaagggcaaagcggagctgcaatttgaagaaagggaaagaatagatgaattggttgaaagcggaaaggaaagaaggagtgaagactgacctcatcaatgacaaaggccgggtgtgaacaccagagggagctctcccggggcgcctttgtggtagaaaagcaccggagcctcacggagatcaccgacgccacgggacccctccatggtggatctccgtggatctccacagtaagccgagatcgcgccaccgcactccatcctgggaggcagagggagactccagctcaaaataagtagatgactgaatgaatgaatgaacgaatgaatgaatgaatggatgttacaggtttccaaggtggacttaaacagatggctttatattaccaaaacttttacattctagttgtttttgtgcctttttttttttttttaatacaggttgaacgttttgtgcttcccatgcatgcagtcaaaaactcagcacacaggccaggcgcggtggctcacacctgtaatcccagcactttgggaggccgaagcgggtggatcacttgaggtcaggagattgagaccagcctggcaaacatggtgaaaccccgtctctactaaaaatacaaaaattagccgggcgtggtggtgcatgcctgtaatcccagccactggggaggctgaggcaggagaatcgcttgaacccaggaggtggaggttgcggtgagccgagatcccgccattgcactccagcctgggtgacagagtgagaccatgtctcaaaaacaaacaaaaaaagcaaaaaaaaaaaaaaaaaaaaaacctcagcacaggattagagccaaacgtgaactaggaagccgcgcgagtctcctctctccggtggaagagctgggacgtgtcccccacaccgcgacgaggtatgaggaagacgctgtctcccaaaggcctggacgggatggctccaagctcttgttctcctaacatctggacaggcgctctttgaagtgtatgaatatatttttaaaagattgggcagtaagcttgtcttccccgtgctttctcgaaagcttactgagctcgtggccctgagcgcgggccggcatagatttcctcttccacccgctgcggcttttctgagcacctggaagcatcggggtgtgaagtcaaaccagacgtgggtgaggagagtgtggcttgccttccctgccgggcagaatttcctgaaactgggctaattctttgtagaaatgtgaacgctgaatttattaaaaaataataataaaacacaggaaacaacttacatgtacataggtcttgaagtgagtgaagcggctgtatttttttggggggggcattgcttttgtttttgtagaagagattgagatgatactctattctaatcaaaattagagatttgtagtgggaccagaaattacgtacttaatacccctgccagttttccccgcgtcctgctgggttgaaagttccagagctgccgtctaggcctcgtgtttgtcagacacccacggctcctgcgaggtcgcagccatgagctggcgggggtgagtacacaagcccagatcccccaacccgaactgcggctgccagcctcagagaaaggcgcccaggtgtgcgggcagggccgagacccccgggaatctaagataggccaaggttttcacctagactgtcaaggctggaggagtaggtggcggcctcgaccctccctacacgggacccattcttttcttttcttttcttttttttttttttttttttttgaggcagagtctcactctgtcgcccaggctggagtacagtggcacaatctcggctcgctgcaatctccacctcccgcgttaaagcgattcttctgcctcagcctcctgagtagctgggactacaggcacatgccaccgcgcctggctaattttttgtatttttagtagagacggggtttcaccatgttggccaggctggtctcaaactcctgatctcgtcatccgcccgcctcggccttccaaagtgctgggattacaggcgtgaaccaccgcacccagctatgcaggacccattcttactgagtgagactcgggagtcatgacctggtgtctcctgcccaccctggtcccaggtaaatctgaatggaagcaggtatgagagcctgtcctcgcctttgattcccccaccctaccctgggcctcacaacggtgctacctaagaaagtctcttcccccagtcagcctggtgagtggtcagccgaagaggatctgacgggagtgtagatgtgagatagtatctttgttgtacctgtttgtggtttagctttgtatttaaacaaatgaggaaataaacttgaaaattatttgtcatcataaagttgaaacaaaaattattttaaaaaataaagttttattttaaaataaaatagctaatgagtatcgtacattacaattacatttcctttctaaacttttttgttttcctttcagttatctgtctgcttttttttctatatacttatcgctaattcaaccacagactcttctcttttgtgtaaatcttttggtatgttcaaagatatttggaatttccaccttcctggaggaatttctcccatagccatgtgccctactctaatttagattgtgcactctggatctgatgcctagataatcttcaccaacctcggaatcctcgaattgtactctacatggtttttcttctcttctaatgcatcccatttcctggaccgcatgtattgctctcctagtttattattcctcattctgatgacgtatgcctttctttcattggcttcctaagaacttcatgtgagtaaaacatttttgagtatgtggcttcattttatacctacacttaattgaccatttagtttggtgtagaattctatgttggaaagtttctttcatgaaatattaaaaagctttttaaagtaaactaaatacttaaattatttgtgtaattgagaattgtaccaatttgtagataacttgtttttttccttactcaatgtgtttaattttttgaatacttaatacagtcacatgtttagcagaatgttcatagtaggaaaaaaaatgtactgaagtcttcatctcattcatgaccccatctgccaagttcctacccctgtaaccactgtctttaacttttttttttaagagatggggtctcgctatgttgcccagactatactcaaactactgggttcaagcaatcctcctgcctcagcctcctgagtagctgggatataggcatgcacacatgcccagtgctcactttttaagtgtccttccagggtttcttcatgtatatatagaagattacttgacactattctttttctttttcttttttttttttttttttttttttttttgtgacagagcctcgctctgtcacccaggctggagtccagtggcacgatctcggctccctgcaagctctgcctcccgggttcacgccattctcctgcctcagcctcccgagtagctgggactacaggcgcccatcaccacgcccggctaatttttggtatttttagtagagacgggtttcaccatgttagccaggatggtctcaatctcctgacctcatgattcgcccgcctcggcctcccaaagtgctgggattacaggtgtgagccaccgcgcctggccatttctccccttttcaaatgcaaatcatgtgtatttcttgctctattctgtgtcttgcttttccccttaacaatgtgtcttggagacatgtccatatcattacatggagagttcctcatttttaaaagagagctgcatagtattgcactggatagatgtgccataatctacttaatggttctctattggcggacatttaagtttaaagtaagttgtttaagttataatgtagtttccagtcttttgttattttaaacaatgcctccatgaatactcttataaacacctacttttgcacacatgcaagtaaatttataggataaatccttaggagaggagtttttggctcacaggacatatatgtatgtttgtaattttgataaatattaccaggttgccatttgtaggagttgctccagttatattcttcagccccaccagataaataggttaagatacctatttattccacagcctcactagagatactgtgtggacaaattttggggttttgcctatcctttatgaggtaaacagtgtagtttaaatttctattttttcttttatacttcttaattaattttttgagacagtcattctctgttgcccaggctggagtgcagtggtgcaatcacagctcactgcagcctcaacctcctgggctcaagcagtcctcccgcctcaacctcccaagtagctgggactacaggcataggccaccatgcccagctaagttttgtgtttttagtagagacaggatattgccatgtttcccaggctggtcttgaactcctggactcaaacgatccttctgcctcagcctcccaaagtgctgggattacaagcgtgagccgtcgtgccaggcctgtttttttaagagtgatgctgatccttctttcatatgtttaagagcccatttatcctcttttgtgaattatctcttcaaatcctttgttcattttactatttcaatattgggattttgatctttttcttgtttgatttccaggagctctttataaattaggttaatattttaccattttttttcttctagtttgatcagtcccttagaattgaaggcatctctggcttccagtgtttccaaaaagcctgacccccattcccatgtcaccacctctcaggtaaagagcaggaactttgctccaataggccccttccatgtgacctctgcaatcacagtccctcgcttcccccaaaataacttcacttttacagtcatcagcacttctttgcatttagaagttttaccacccaaatgcatatctttagagactccaatttagtcttacctttaaaaaaaaaagttatctgggatgtgtttttttactctctaaattacttctccatttttcccctttgtttttctcttgaagaactggactccttgaccaatagggttttccacagtgtgagtcttgctaattgcatgctcatgattcagctcagtatatccctcaatcctctatttcttgcaaactggcagctggattcagagatttaatgaaactcaggtttgccatataggaggcacaaaatgtctggttgtctctcctgttgagatgatggtaggtacaggtgctaaaatgtctacgtgggtggtgggttggggagaagttgttgcaagatggtggaattctaagtctaaattttacgtttcatttataagttgaaacactctttatttttatttatttattttttgaaacggagtcttgctctgtcacccagctggagtgcagtggtgtgatctcggctcactgcaacctctgcctcccaggttcaagctattctcctgcctcagcctcctgagtagctggtattacaggcgtgcaccaccatgccccactaattatttttcttttttgtatttttagtagagattgggtttttccatgttggccaggctggtctcaaactcctgacctcaagtgatccacccactttggcctcccagagtgctgggattacaggtgtgagccactgcacttggctcattattgccttttcttgagttcttcccctccagtttgctctctttctgtgactcctgttattcagagtttgcacctgttggattggtcctccatgtttcttaactatttctctttttatttcactttttctaggaaatttcccaaacattattttccaactctctgtttaccttactacttctgccatcatattttattttccaagaggtcttttttgttttctgttgttattataaatagcctcctcttcttgtatggatgcaatattttctccctgaaaacaatgagtttttaaatagctttcttctatctagcattgtgtctatttcctccaagttgtcttttttctgcttgtggatttgtttaactttcaatactagagattttctttgaatgtctgaggatctttggatgtccagtcatatttataagtagggcagtatctaggctgtttcttcagggaagattcaatgtagtatctttagatatttcttcctgggctgatgcctagagagaactgtttgagtctttatatcttgtaataatagtattcctgaaatccaactgtaaaaaggctggagaggtctcaacttccgctatatgtatttttatgcagtctccctgttatcagtatgatgctcctctaatcctcaactctgcctaccgtccaaagattgttttatcttccccagaggggaaaacctcattcttactccgcagttggagagggagtcatttgctgcactgagtcagggaagagatctggggacctaactgcttatttcatttgcaacgaatctatctgtttttatccccatctttgcatccctttctgaagacacttgggtcagccactcttgagatttttgagggtcctgaggtataaattgggttgcgactctgctttctccactgctagcttcagtctgtattcactgtatgtgattcacctgaggatttattaaaactgcagattggtttcatagatctgagctggagcctgagggtctatgtgaatagcagtctcctaggtgatgcttggaccacactttgtgtagatggggctcactcatttaccgtccatctgttcattttccagcctctgaaattttgtccttggagatttgtacattttttttaaagttatgaaaattttcaaacatacatacaaatagttagaacagccattaaccagtggtcgatcctgccccatctatactttcatccactcgacccccagcacacacactgcattatgttggcgcaaattccagacaacctatttcatctgtaaatattttagtatgtattattttaaatagtgagatttaaatataaccacacatattaatttgttagggctgccataacaaaccaccacaggctgggtggctgaaacaacagctctgggggctgaaagggtgagatcgaggtgtcccaggggcggtttctcctggggccttttgcagcctgtagatggctgtcttctcgctgtgccctcccacagccttttctctgtgtaccagcatccctagtatcatgtgtgtgtgtccaaattacctctttaaaggtcctatctccaaatatagtcacatttggaggtgctgggagttaaaggcttcaacatatgaatttggggggatataattcagcccatcataccataatttcccattgtcttatatatgtaattctttgttgccatgaattcagataaattctacacattgcacttagttgatatatcctaagtcttaatttttgtattgttgttgaaacaatttattgaagtaacaaattgtaatcctatagagcataccaccatgtggattttctttactgcatcctgtggggtcattaaataagttattgtcctctttcttgaacatcagtagttgaatctacaggtttggtcgggttctaattttttggcaagcccactttgtagatagcaaggtactcttcaatttccacctttcagtattagtattgatgatctttggctacctccatttagtacatcagaggtggcaaattgggcagtttccaaattttatcattccttattcactcatattagctagagtacttccaaaaaaagtaaacatcacctcacttactattctgtcaccaggtggtacagttagcacaggaacggcaggagaaaggcttcttggccagtacttaagtttaacaactagagactaggttctctagtgttcctcagcatcacaatgaggttttcttattcattttagaatctggtaaaacttgatttactgttatgttagtggagttatgagaaggaacatttgtttaaagaaggcactgttcattggaagttataatttatgtagccaatttcctgctattggagatttacattaattccaggtttttacttttatatttaatgctgtgagatgaatattctttaaaaataagttaaaacactcatttttagtgtataatttgaattttgaaaaatgtatatacttggaccccaatccagatgtagaacattttcatctctacagaacattgcctggttcacctttgccccagcctggcttcagatttctaccgatagtctctctggccatagggattcgtttttctgttgtgaatcccatataattgaaccacacactctataccctttattgctaggctctttttgttcggcatgtgatatggtttagatatgtgtcccctccaaatctcatgttaaaatgtgctctcccatgttggagatggggcctgttaggaggtatctggatcatgggggcagatccctcatgaacggcttggcaccgtccccttggtggtaagtgagctctccctatgagttcacgcaagagctggtcatttaaaagcatgtggggcctcccccttctctctggctcctgctctcgccatgtgagatgcctgttccccttttgccttccgccatggttgtaaacttcctgaggcctcaccagaagccgagcagatgccagcgccatgcttcctgtgtagcctgcagaactcttgagcccaataaacctctttataggccaggcacagtggctgacgcctgtaatcccagcactttgggaggctgaggtgggtggatcacttgaggtcaggaattcaagaccagctagccaacatggcaaaaccccgtctctactaaaaatacaaaaaaaaattagccgggcatggtggtacatgcctgtagtcccagctactcgggaggctgaggtaggagaatcgcacaaactcagaaggcagagatggcagtgagctgagatcacgccactgcactccagcctgggcaacagagcaagactctgtatcaccaacagaaatacctctttataaattaattacccagcctcaggtatttctgtatagcaacagaagaatggcctaacataacatgtttttgaggctttttttttgaggcttttccctgtgtggagcatatattaatttttgttgctgagaagtattccattgcctagatttactacaatttgtttatccattttcctgtggatggatatttgggatatttccactctggggccattggtgaataaagctcctacatatatttgtatacaagctttttttttttttttttttttttgtgaggcagattctcgctttgtcacccaggctggagtgcagtggcatgattgtggctcattgcaacctccacttcccgggttcaagcgattctccttcctcagcctcccaagtagctgggactacaggtgtctgccaccatgcccagctaacttttgtatttttagtagatatggggtttcaccagtttggccaggcttgtcttgaactcctgacctcaagtgatccacctgcctcagccttccaatgtgctgggattccaggcatgaaccaccgtgcccggcctctactgacaactgaatttcagacttctggcctcctgaatgtgagagattaaatttccgttgtttctttaagttgtgttagtctgttttgtgtcattataaagcatacctgagactgggtaatttataaagaaaagaggtttatttggctcatggttctacagactgtacaggaagcagggcaccagcatctgcttctgttgaggcctcaggaagcttccagtcatggtggaaggcagagggggagcaggtgtgtcacatggtgagacagggagcaatgggaagagaagggaagtcccagactctttttaaccagccagctctcttgtaaacaaataagagtgaggacttactcattactgtggggagggcaccaagtcattcatgagggatccacccccatgacccaaacacctcccactaggctccaccttcagcattggagatcacatttcaacatgagattcaaaggggacaaacatccaaataatatcatgagccattcagtttaaatttaccaccagtcaactgggcatggtagctcatgcttgtaattccagcaatttaggaggccaaggcaggaggaatgcttgaagccaggagtttgagaccaacctggacaacgaaacgagaccccatctctacaaataaaaaattttaaaaacttagccaagcatggtggcatgagcctgtggtcccagctacttgggaggctaaggcaggagcattacttaagcctgggagttcaagtttacagtgagctttgattgcaccacagcactccagcctgggcaacagagcaagattctcttaccaaaaaaaaaaagaaaaaattattgcctattataatttgttgtgacagccctaggaagctaatatatctacccaggattgcaaacgatttcttctgttttcttctagaaattttagttttatttctacatttagtcatatgatccttttttagtttatttttgtgtatggtgtaaggtaagagtgaaagttcattttcccccatatggatatccactttcagcaccatgagattgatcttggtttttcatagagacttcttatctagttagggacgtgaccttctattgtttgtttttatcatattagattttattaaatgctgcatctgcgtctcttcaggtgatcttatagtctttctcctttattctgttaatgtggtgaattacattgattgactttctaatgttaaaataagtttccattggccatgatgtattgatggattcagtttgctaataatttgttaacaatttctgcttccatgttcatgagggatgatgatctatattagttttcttgaaatgtctttggtatcaaggtaattctagtccttgtgaaatgagttgggaggtactctttaagtttggtattttttccctaaatgcttgatagaatccatcaatgaagacatctgagcctatattttctttgtgggtaggttttaaatacagaatcagtttctttaatagggatttttttttttttttttttttttttgagatggagtcttactgtgtcacccaggctggagtgcagtggcacaatctcggctcactgcaagctccgcctcctgggttcaagtgattctcctgcctcagtctctggagcagcagggactacaggccaagccaccatgcccggctaatttttgaatttttagtagagacgggggtttcaccatattggccaggatgggcttgaactcctgaccttaggtgatccgctggcctcagcctcccaaagtgctgggattacaggcatgagccaccacactgggccagtttctttaatagagctatttagggatcttttggacggagtttcggtagtgtctttccagaaatttgtttcatcatacaaatttatcgaaataaagttgttcaaaatagttccttattcttttaatgtttctaggtactcactttcccaattttggtaatttctttcttaatttggctagaggtttattaattttattggttctttttttcccctaaagaagcagttttgtatcgattttctttctgttgttttggggttgttgttgttgtttttgttttgattgatttcctttgcttatttatttatttgagacagggtcttcttctgtctcccaggctggagtgtagtggcacaatcttggctcaccacaacctccacctcctgggctcaagcgatcctcccacctcagcctcccaagtagctaggaccacaggtgcccaccaccacacccagctaagttttatactttttgatagagatgaggttttgccgtgttgcccaggctggtctcaaactcctgggatcaagtgatcctcctgcctcggcctctcaaagtgctgggattacaggcatgagccaccatgcctggccttatttttgtttgttttaatttcattgatttctgctttttttttaatcttccctttaacctactttgggtttaatttgcttttttccttaaagtttaaatttaggttattgaattgagcccttctttttgaaaacaggcaaatataagaatatcagaagagggccgggtgcagtggctcacacctgtaatcccagcactttgggaggccaaggtgggcagatcactttaagtcaggaattcgagactagcctggccaacatggtggaaaccccatctctactaagaataacaaaaattagccaggcatggtggtgtgtgcctgtaatccctgctacttagcaggctgaggcaggagaatcacttgagcccaagaggcggaggttacagtgaggcgagtttgtgccattgcactccagcctgggcaacaagagcgaaactccaactcaagcaaaacaaaacaaaaccaaaagaatatcagaaggaaaaatgcaaaagtatatgacttttacaaatatatgacaaattaaaattgaattttgagttttaccaatattcttacatttgtatcatggctttttaaaggtcttttttctgataatataaataatacatcctgttaaaaaaatttcaaaggatatagagaataatgaggaatggcattagtcaggaaaggccaaatcccattgacttaatgcaacaaaggtttatttcttgctcatactatacacccattgtgaatcgccaggggctttgcttcacatggtcactcaaggacccaggttgacagaggctccaccatcttgtaatgtaccatctggaatgcattgcctccccgcctccccagcccatgatggggaagacaacaatgaagggcaactcatctgcaataaaatgttttggcctggtagaccattaactgtagggatcaaagaacaaaaatcctccatgggcagaagcagagatgaagcaggcatgtgggtgagcactataattctacactgaaggagaaaaataaaaatcatctatcccctaccttgagataacctctgcttgctgtcttctgcctggcctcactggccttccttatcgccagccttatgtttgggttggtgggaattactcctgcttctggcagatcactgataattcttggttatgttctacctttgcgcctcttttgtcagattttatcagtgtataaataaaacaggaaaggacaaatcaagaatctctcactagttgtcttaataaggaaatttcatatttctttttaaaactttgctttagaatatctctggaaatatatacaaataactggttatagtggttgtatctagggagggaaactggctagacagcgctgggcagagtgggggtgttggagggaggattgggtggcacaggtaactttcactgtaatacacatctgtcacccaagttttgtatcatgtaaattatatcacctatttttaaaaataagtaaaataaaaacatttccatattttctatattgaatataactgtactgtgcaaatggatgaatgcaaaacattatcagagttgagtgactttttttttccactgaatttggacacatcaagcgaagaccacatttcaaatacaaactcttcaaagtttatatttaccttttggagggataaaatttcattatccaaatggatagtcaagtcacaatcctatggatatcagtaatcagtacagtcactgttacttgaatgtcgcttttttatttttttaattattattttttttttgagataactgtgtctcactctgttgctcaggctggagtgtagtggtgcaatctcggctcactgcaacctccccgtcctaggtccaagcgattctcctgctgcagcctcctgagtagctgggattacaggcgcccgccaccacgcctggctaatttttgtatttttagtagagatggggtttcagcatgttgaccaggctggtcttgaactcctggcctcaggcaatccgcctgcaccagcctcccaaagtgctgcgattacaggcatgagccaccacatgttggttttttagaaagctctttcacatacatacattgggtccttttctacatttccagtgagttaagccataattgtggtttactgaagaacgtgagctttgaagtcagacttgaggttgaactttagctccaacacttacgagtcatgggacctagggaaatgtacttattaaccacaagcctgttttcctcatggggaaaaattatatataccttttatgactgttgttaagaattagaaaaacagtatgtaaaacccctgataaggctatttctcccacaggcttgctccacttatcgggctcaccaaatacagctgcagtatgaattccatcttctacacaacagtaaaccagaatgttcatgttcacagcgttcatctcccatcctgttgtctaacgcacatggtttttttaaacttttctaagattgcatgagattctgcaacacaactgattataaaaacacttgaagtttttacctttttttttactttccaactctcgtgaatgtacagaggactttccagaagctacatgatgtgtgatatttcagctgatgaaatgtagatgtataggtaatcggtcagagtggtgggagaaactgttgggaaaggagcaggccttctgaaaggtcggaaggcttcaggggagaataagctgaacgcagctgttctctgaccttgaggcagagggcaaggagtaggtacaaggacgtgtaggagaatttatcttaaataggcttgttcacttgtgttgtccagaaacgacttttgatcatcagcgcgcatgactgctccctgaaaggaagaacaataatgttaattacccgcagactgtgtttgctccaggctttcggcattatgtctgtactgaataaaagcaagcagctccagctgttcgaggctgctctcttcttcagccattagtgccgggcagcccactagctgctgttacactgcatatctgtgtctgagtactcctttcttcagttgcttggccagggtctgtgggacagacccagcagctggtgccctgtgtgaggaacgctgcaatggatcgcgacggaaccctcgaaaacgaaggtgaagagactgcgcagtaagccagtaattggaattggagccctcttgggatttccaagttcgagggaattttcaagctagggtttcacattgggacaacacttactcaacagaaacagcatataaaagtattgaaacaactgcttaaagctggtggagcctcagtttgaggcccaattaagggacctaatgcaaactcttgttttccataacccatagttcccagaagaaggcacgttagacctagagctctgggagcaagtgggaagaaatcttaaacgacatcatgcacaagggcaatggggtcccagtaacatctttaacattatgggccttagttagggctgcttgggaggaagaaccatcatctaccttactgcctccgcctcctcccccagccccaccgttaccgggtaaaggtgccacagaggagacagaggttttccctgagccccctcccccaataaactggaaaaaggacaagggatacactacagttatgggaccctgtcttaagcaagcggcattagaaggggagctcttggtctgcctggtaatgcaagatcaacaaggcaatcgggtacatgaacccattactttcaacacttacaaagagataagaaaaagcattagagaaaatggagccgctagcccgtttatgaaaggattaattgaggccatggcagacaacttccatatgaccccatgggactggtcagtgctaactaaaacaactttagaggcaagtcaatacctcctctagagggcagaatttgatgaattatgtgcagcagaccgctttacgcaaagccagaacacgagctgtaactactgcgcctgtcaaacctggcactgcacacatctgtactcttcaatcaacaaaacctgatgcaaaaaaaagggggagatgtagatcagtcagagtggtgggagaaactgtagggaaaggagcaggccttctggaaggccggaaggctctacatagcttccgggggagaataagctgaaggcagctgttttctgaccttgaagagggcaaggagtaggtacaaggacgtgtaggggaatttatcttaaataggcttgttcacttgtgttgtccagaaaccgacctttgatcatccgcatgcattactgctccctgaaaggggggacagtaatgttaattacccacagactgtgtttgctccaggctttcggcattatgtctgtactgaataaaagcaagcagctccagctgttcaaggctgctctcttcttcggccactagtgctgggcagccccctagctgctgttacactgcttatctgtgtctgagtactcctttcatccgttgctcgactagggtctgtgggacagacccggcatagatgaaaattcagctgtctgctattaagccagacactaaagcaagttgtgaaatgtgaaacaatgccactctgctcactaaattattgtttggtaaaatatagtaatttttaccatattatttaaataacattttaaaaatgttattgatgttaacatgcatcaagggtcaaagggtcctgaaaccaaacactttggaggacagctgctttatcctgtggctgaaaactataaagcaagattcctttaagtaaatgtggtgtatgcatcaatctctccatctttggtgtgctttcaatccaagtatcccctttcttccttttgcaagaaagaaactaagaatgtaagcagttacttcctggcttcagtcccacaaaaagctacaatttttctaagcagtgatctggaaccagtttaactggactcttgctattaagatagctcttaatgatgtttcattttgttttctatctttcacacagagcttactcacatagcatattggtatatcaaaatgaaatgcaaggaaccaaaaataacataattgaaggcagtaaaagtgaaattaaataggaagatcatcagtcaaggaagacccactggagagtaagtatgcaagttgttaataattaattgggttacaaagggaaaaacagagactgggtcagtgaaacgaaatcatggtttgtttccctgaggccctgctaatacctccaaactgggccagatcgtaaagcaagataccttgaaaaggactttcatgttaacttttcaggttgcatatgagttcattcacaagtagtttaaagaatcatgcaggaaaaggaccagatcttgtaaatctcttgagtccctgtattttgtgaacatttttctagagaaaattcaggtagcttatcaaaggatttctgtcttgttcagggagttgttttaaaaaacaaaatattggaattttgaacacttatagtggtttacagggtaattggggtagagtacataaaattggtgtcgtctaagaaagctctgattggtttccatgatcgtggtattcaggaactatcgtaaattggccaaaatcttgttttccagtttcttcctttcgctttttattgcctcaagttgcctgtcttccccgctcttatttttcttctagctttatgattctcttacatgttccatgtcggacttgtcttctttattccagtcatcttctgaagaggttcttggttcctgccttggtggctgtagctgattctctttctcctctgtggaccttcctcatcccctaggagacacaagcgtcctcctccaggtcctcctcctccctacttttgtcatcttccaggtgcctccacctgtcaagagtcaatgatgaaacgggaacttggaaaacatcccttggatgttgcctacctggcttttctttttgcgacagagtgtcaatctggcacccaggctggaatgcagtggcatgacttggctcaccacagccttgacctcctgggcttaggtgatcctcccacctctgcctcccaagtagctggaactataggcccccaccaccacacccgagtaatttttgtattttttgtagagactaggtttcaccatgttgcccaggctggtcttgaacttctgagctcaagtgatctacccaccttggcctcccaatgtgctaggattacaggcatgagccacggcccccagcctgacttggctttccttacttaatttagaacaggagttataaaagttaaaatcatgtgagacagatgattctattcttttatcctaaagttacatttttgaaaaatgggtctttatgaatccacaaaatttcctcaccctcattttaaaccaacattggttgtttaaaactaagccttttttgttttcatttttggcacaagggggacttcatatggtcttactcatcttggcttctttatccaagcaacaccacttgtaagaccaatggcatttgtcaagttggcagctacatttctgtgcccttgtatatcaaatctggaatgcaacttttttggataagatcaaattaaactgtactatgtttaaatacaggggaaaaaaacttgagtgtgggaagtacttgtttgattgggtcttttatagttatgaaaatagattttgtattattgcctttacacatatatacgtttgtataagtagattatttgtataccttaataagttatcttatgacagatttatggccatgagagtaatggttcaatctgtcatcaaaactgatagccctctctcacagtgatttatttttattttaggttcaggggtacatgtgcaggtttgttataaactcatatcagggtggttttctgcacagattattttgtcacccaggtactaagtctagtacctaatagttattgtttctgcttctctccctcctcccaccctcctccctcaagtagaccccagtgtccactgtccccttctttgtgtccatgtgttctcatcatttagctcccacttataagtgaaaacatgcggtatttggttttctgttcctgcgttagtttgctaaggatgatggactccaactccatccatgttcctgtgaaagacatgatctcttgttttacgctgcatagtattccatggtatatatgtaccacattttctttatccaatctgtcactgacaggtatttgggttgattccatgtttttactattgtcacactgatttatcttcagacaaaattatttaatcatcagtgacctatttttaggcaaatttaattttttcagttttcagactcaaaactccatttttttccttaaagtttgggaaaaagaaagtatactactactgtattggtaacttgatatgtacctttttagccttttcctatgcatgtatttcttacatgacatgttgctgcataattttgtaacctgcatttcacttaacatactgtgaaaatttatcatgacattatttttttaacatgtaccaaattcacaaggcttaaaatttaacaaatgaaggtagagtgaaaagtatgaaaactaagtcttcctcctatcctgagaaacatttttaatggctgcatatcataaagatgaccatatccagggtgagcatccctaatccaaaatctggaatctgaaatgctctaaaatccaaaactttctgagcactgacctgatgctcaaatgaaagtgtgggtttttggattagggatgcattcaagatccaaaacacttctggttccaagcatttctgataagggatactcaacctgtgtttcgtttctttcttgtttttttcttttttcgagacagggtcttgctctgtcacccaggctggagtgcagtggcacaatcatggctcactgcagccttgacctcccaggctcaagcgatcctctcacctcagcctcttgagtggctggaaccacaggtgtgcatcaccatgcccaggtaatttttttttttttttggtagaggcagctccctatgttgctcaggctggtctccaactcctgggctcaagccatcctcctgccttggcctctcaaaatgctgggatttcaggcaagagccaccacacccagccaacctgtgttgttttgaaccaatctccagttgttcacatttgtgattgactgggtttgttgttcttgtcatttttggggttttttttttttttggtttttgtttttgtttttttgctatttataaatactgcgattgagtagtattgtagaaataagttaagtttgggtcaactgattttttttaaggatgtgtttcttgaatctcctacctttcctttcagtcctttcctgattcttcttctgacttctttcatcatctttttcctgcttccaaaatgtatgtatcactgaagcctcaactcctattcctttgcctttacctaccgcttcctaatgttctcatgtatccatactgagtccctgttccttccctgtattctcgtctctccacatgccatacctgaaagatcatatccagaagataaacacttttctttctttcctttacctatgttctcattatttttagctgaaaccacctgttttcagagcttcaggaaaagacttaatctgaaggatcctgcagctaaaaagctttgaaaactgtgttaaggggccccataagcatcgcttctaaacttcactgacaaaagggactggggtcatgctgtctggagtcagagtgaggtggggttaaaagctctatgtggttgttttgcatattactatcaagcttctattttaggcatgagttttggccctggtagataaaaccatttctctatctaaaagttattaaaacctgtacttatatatagaagttagtaatttatatataacattttggtttaaaaatctctgagttctggaccatctgggtctcaaaaaaatgaccagagtatacacattaattttgttctgtattctattaagtattatgtgacatataattcttattcatatatttatttggggaaatgattgaattaggcttttaagaatagtggtgcttgctttgtaaagtttcaaaataggtaacattaaggttttcttttcactttttttgcagggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagattattgcctgaatttctctaaaacaaccaagctttcatttaagtgtcaaaaattattttatttctttacagtaattttaatttggatttcagtccttgcttatgttttgggagacccagccatctaccaaagcctgaaggcacagaatgcttattctcgtcactgtcctttctatgtcagcattcagagttactggctgtcatttttcatggtgatgattttatttgtagctttcataacctgttgggaagaagttactactttggtacaggctatcaggataacttcctatatgaatgaaactatcttatattttcctttttcatcccactccagttatactgtgagatctaaaaaaatattcttatccaagctcattgtctgttttctcagtacctggttaccatttgtactacttcaggtaatcattgttttacttaaagttcagattccagcatatattgagatgaatattccctggttatactttgtcaatagttttctcattgctacagtgtattggtttaattgtcacaagcttaatttaaaagacattggattacctttggatccatttgtcaactggaagtgctgcttcattccacttacaattcctaatcttgagcaaattgaaaagcctatatcaataatgatttgttaatattattaattaaaagttacagctgtcataagatcataattttatgaacagaaagaactcaggacatattaaaaaataaactgaactaaaacaacttttgccccctgactgatagcatttcagaatgtgtcttttgaagggctatgataccagttattaaatagtgttttattttaaaaacaaaataattccaagaagtttttatagttattcagggacactatattacaaatattactttgttattaacacaaaaagtgataagagttaacatttggctatactgatgtttgtgttactcaaaaaaactactggatgcaaactgttatgtaaatctgagatttcactgacaactttaagatatcaacctaaacatttttattaaatgttcaaatgaaagcaagaaagtaaaaattgttcttaaaatgatttggcataaagttcaatgtaagaggaagaagaagattacctcattttaaatgtagctaattaattttaaaaagtatatctctgtttttaatgcaaatattcctggaagaagagggttttggttgctcaccttatggaactgggagcagtgactaggtccctttcgatgattcagcagattcgttttcatattataaaacttgtatgtcatcacatacttgcatatcacatcataatcacgttagcaatgatgtatcacacgtaaaagtagaatttctcatcctcggcacgcttgacatttggggttggttaattttttgttgtggggcagtttagcaggatccctgctctctgcccactgactgattggtggcacctccatgcccagtagacacaataaaaaatgtctccagacattgccaaatctcccccggtggataggcagagttgcttcactggagtaaaacaatatgagtggcaggatcatcatcttacattactttaggaattaagctacatagatattttttatcaccatttaaaaatactatattgcataaatctaaacctagcttttcctaaattggtggcttttgattttttttgatatttatagtaagatatattttttaacatcatgacctatagacttgtatgtacgtttatgtgtacatacaagtaacatacttacccttacataacatgtataacatgtacatgtacatacaagtataacaatacttacccttacatatcatgcaaatatgttttttagtgtcattttttaaatgctggtttttatccactaaattgagttgatgatccacaaatggattactttctgttatttgaaaaaatgtcctaaaacaagcgctatggaacactaataatggcaaaaagatttaagaaatgtgtcctgtgtgccaggtaccgtcttaagtgtttgttttacatgcagcaactgatttaatccttatagcaactctgacaggaactattatccccttcttacagatgaggaaatttaaacattgaaagtaagaaactcactatgatacaactagacagacattggggaagctgggatgcaaacccagaattctggtccacagttcttgctctttaccactgtattacattgcctttcattggtgccactgacttctcaaaaagaaaagaatggtttcagagtcaaatgtgaagaatgttgtttcttaattattattatttatttttcacttgaaaatgtacaacgcccatgaacaccttaaggctttatagtgctataatgaagaagaagaaaaccatttacttgagcacacaagtctctttaattagctaaaattaattaattaagcatctataaagacaagttgggaaatgctcctggagagtcagtcaagaattctttgagtagcaggtaatacaaactcaacctgagccattctaagaacaagctggatattggcaagaacttacttagtaaactactaggagaatctctctgagttgtcggtttccattttgtgtccacaaagtgggtgttctggctgccagcagctcagggctttcataattaattacacttacttaaagcatctcctaacttcttcaaatatacagtcccggggaatgactgttcaacctgacttcaatcatatgtccacctctctatgatcagatctgttaacagaagacatggcagggaagagaaataataaccaatataatgggtggtacaatgttaaaatatatatatacttgagaaaataataaataataggaataaaaatcacattctataaaaaccaaatgcatatagacagccaactatatcgaaagtttaggacaaataatcctatgttcaagacaacatcagggtgtgtttaaacagtttagaactcttcttaaacccggccccctctttccttctattactttttcctctaaatatattgccttctagttgttggccaaatatgggactgaaatatgtttaaatatattgaaattaatcagtaaagacttgcttacactctttgcagattttaaatcaggagatttttaaaaccatttcaaacctcactaagctttttgttttgtttacacagaggattccccatgtctcataagcttaaagaaaaaaaaattattcaatagaccagtcaaatggaagaggcttttatttgtaaagaaatgaacttacaactgatctacaatatattattgtaatataaacaatataaataaatgatcctgtaggcccactaatcttccatccagacccacatgaagcaatgttacaacaatattctatatgaaaatgtgcaggtaacaaaggtgcaattacaagcaagttaagcagcagagtataaggtgctttaatttaatagttaatgttgccatcaacaaacatttaaatgctcaatttacttcactgaatacagacacaacaaatatgaaaatctaaattcatacacatgctacttaatatgaaagtgctttctcttttttaaaaaaatacaccaaatggacactttttacatagatcaaatgtgctcttacaatgcaaaattaaccttcattttcaggttatacattttaaaactgtagctatcaacaccaatctaggaactctaatgctaagagtgctaaaaactatttcatttcttgtaaggaggactctaatacaatatccaatgtaaagaatacatctatatataatcttaacatgttttctgtaaagataaaaaatgttttctttccccttggtgatctttgttcatcctgggtggatcatcttttgaggttttaataatatgaaagtcctattttagaacaatgggaggaaccaaaaggggaattaaaaaattggttaacgtgtgcttgaagcatccaaaaaacaccagtttatcacaacaattggtctttgctaaaattaacaaaattttaataagcaagacgacaaaaagtactaatttaaaaggcttgaaatgcctgccaccattgtcagtatccatccatccaaccttcatttactacaagcacaatactactttgaggatagtttttggaacttattttgacttttttccctataggaaaaacaaagaccaagcttttgaaggagaggactgggaatctagtttaaatgtctacatccaaaattatatcatctttgcgcattcagttgactttttaaaatttaagaatacatatacaaaaagtacttatggaatacatattttaacagcataacatatttgaagaattagttacactttaaaaattaaaacacttgaaaagtattttttaaaccagtaccatggaataactttttgaaacccagattatctggctacttagatgatagtcttcctgttttcaattagtttgaaagattctaatatagattctaacccaacagtttatatggatattttcctgctttaaaaagctgcaacaggctaggcgcagtggctcatgcctataatcccggcactttgggaggctgaggtgggcggatcacttgaggtcaggagttcgagtccagcctggccaacatggtgaaaccccatctctactaaaaatacaaaaaactggccaggcatagtggtgcatgccagtaatcccagctacttgggaggccaaggtgggagaatctattgaacctgggaggtggaggttgcattgagccaagatcacaccgctgcactcaagcctgggtgacagtgagactctgtctcaaaacaaacaaaacaaaaaagctaaaacaatgataaactatttttaatagatattttcattctatatctttatggagaatgtcagtatcaactgatgttaacaagtaaagctttgtcaacaggaattacaatgtgattcacagatcccagaatgacaaggaagggaccttaacccaataaatgattctcccattcaatgtttaccccctagatacttaacaattcaagcatggaactgtttcatgtttacccgttctacatttaaaggatgcccttttactatatatgtgctttctagaatattactgattcttacatatctttaaaagttggatatttgtaatagcttaaagtacagtaacacttattttgtgtaatctttcttaatttaaaaacaaaaaataaatgaacaagtcagttccaatgatctcctttgagatttttcagttttagaaagttgctacactgtcggacaggtgtggtggctcatgcctgtaatcccagcacttagggaggccaaggcaggtggatcacttgaggtcaagagttcgagactagcctggccaacatggtgaagccccgtctctactaaaaatacaaaaattagccaggtgtggcggcgggcacctgtaattccagctacttggaaggctgaggcaagacaatcgcttcaacccgggaggtggaggttgcagtgagctgagatcgcaccactgcacaccagcctgggcaacagagcgaacccatctcaaaaaaaaaaaaaagaaaaaaaaaaaaaaagaaagaaagttgctcactgtcaatactgggtaaaaagctcttatatcaacaccagctttttttttgttctgccacatgccttgtatagcaacaactctggaatagagtcaagtgtcaaaataatgttgtgaaatacgggctgtctcaacctgtaagtccttaatgttaagtctcctaaattttgtaacttaatcaggtatggggccaactgatgtttagtatgtgaaatgtgttataaaaattatgatatgattcactcagaccccttagatgtcatctagcctaaccctttacccaatgtatacaaatattccctcccagttccaagtttattaagattccctctcagtatattaagtagtaatgattatgttcatatttatttaagccacaatgaattttggggggaagattttacttactactagttcctcatgtcatgttcaccaaacactgcacatgtaagtgttcaaatagtttgctaaatgaatttaagtacatgaatgacaatattcatatgtgttcatatattcagtggttaaccaataaggagcatttaggaaaatgtcatcatttgcttgttatgtatgaattttctattttaatccttaggagaacaaagactgtaggtgacccaagaaatggatgcttattaagtataaaatgaacccttaaaaaaggaaagagaataaagtaggaataaccccattacacagcctagaatcatagttttagagctgggaggtaccttaaagatgaattaaaccaaaatcaacttttgagtagtacaggcaccatactgcatatctggaagctgttaaaacagctgagtaattgcccaacatgtcacacacagctaacccactgaaataaaaccccagtctccagaccagtgtgttaatcctcattcatcatcatcttaattcattatttactactgaaatagattatttactgattatttaatactacccaaaacaaaaaatacttttaagagaagcattctaaataaagatttaaacactagacacttctggtttactttaggcaagactaaaaaattctttctaaaacaggttgatgtttaacttcactaatgactagacaccccaccactctctcataaacaccaactttttcaccaccatcacttaaagctccacaaagcttggatttaacactgataatattccatgaaatataacttttaagccaataagtgatggtgactatcaatccttaagatgattactggagtaaatttaaacaggtgctctaaaagaacttactaccttactcttatatttaattaacaccttgccatgttagtataacagtgttttcaaattatgttgttttcaaaactgaaattcattcattactctgctttttttaaacaacaaattttgttttctttctatggattcatactgaacaccaccagtatcactgagaggactagtacttgtaaaaagcagtagaaacaaaaatatttttcaaaagtataaagctagctagaacctcactatgttgtacctctaacatttccgattaaaattgtcatctttaagtaaaattaaatgtcaacaaactataaaagggaaaaaataaaacatctggaaaacatttcccaaatgttcccataaacatgacacttggaaggggtgtgtgcatgtgtctgagtagaaaagctgatcttcagagctgaaaaggagggcagagattctcccttaatgtatgttttctaaattgaaagtttagaaaaagccatattctctggaatgtgatggtaataattatatttgtattatttgtattaatgctttacaactttcaaaaaaaagctttctcatagtacaattttaaaacggattaggttctaaaaactaatatgtaaaactttgaaaattcttaaaaatttaggaaattctttttccaaagaaggtaatctaattttaaatttatttgaagaaagcttatataactactgtgaacaaaactatatgatacattttatgaacttctaataaaagaggacgtatcttcccaaataattttttgttttgtttttttgagatggagtctcgctctgtcacccaggctggagtgcaggggtgtgatcttggctcactgcaacctccaccacctgggttcaagcaattctcctgtctcagcctcccaagtagctggaattacaggtgcatgccaccacacccagctaatttttgtgtttttagtagagatagggtttcaccatattggtcaggctggtctcgaactcctgacctcaggtgatctacccacctcagcctcccaaagtgctgggattacaggtgtgagccaccatgcccagccccaaataatttcttttaagatatacagcttaacaagttgaaattttagtaagattgcatatttacttttcctaatactgtatttgtgcttatctaaagtggatcacaatctttgagatgaaattaaatgctccaagtagatttgtaaaataccaatattgatgaatgtgggtaaacagttcatttcatgatccacactgctgtgaaccaaagaagcagaggtaggcttgtgtttactgaaatccagactaggaaagagaaacctatagctcttcttttcccaattcttagactgagacacaacctagcaaataaaatactatcttaaaatgcctctctttataacaatctacagaggtgattcaactgtgatatctgaaaatggaaactctgtaattctggcaactcaattacaacaacctttgaatttttgacaaatattctccaactgtaataaaaggttctcacctttttcagaaatcaaaaatcactaacttctacatcactggaactattaatatccatgctcccaagcatggagacagtgggtatagagagtgaaagaatgagtctgattacaggtaaatcttgacatataaaaactataacctatttactgctataactggcatctaacaaaacgcattattttgaactatggatgaaagccatatctatcctaaatatcttctatcctcttgggtctagaatgctttgttcctcctacttgtctcctcctctacttccctatccttccccctagaaaaccttccttagggcccagctagttacatatgtagtacacaagatagagattgagcaatcattttgcatagatgcgccagtttccactgcccaaaggttgctctggaacatgactgtcaggtatcagaaagtcctgccccagctgcctcccttcctaaagttagcccccatacgaaatcctctctaaggattctgagacaaagatctctccaagaaagaagttttcatggttttcttggagctagaggccttagagaggtagtgagatgaggccctttcatgccattagctaatgctcaatgccagtaggctgcatgtgttcctgcaatccaccaaggtgaaaaccacaaactataaccaggctgttctggctgaaaatacatctttaaaacattttaacagtgtgtccagtcagtttcatccactggatatggctgtcaggtcagcatcactcacatacatctataatagtgtattctttcaaaaattgtttatacacacttaatataggcatatagcctaagactatattgcctccctaccatacttgtgccattgtggtaccaaaagcctgaagatgtacataatgtactttaagacatttaactgaacaagtcagtgggagacagggcactataacacatttcaattcaatctaagacttgtatttgtgaatagatgtctcattataattttatacttgatacatgaagataagctacgtcaaaaattattcaaaggcatgatcacaataatacttgtttcatagttctaagtattttgatacaccaggaaacaaaaatcaactgggatccctaatgaaagaaaattatttcttctaagtaaaacatgaatttcacttcaaaagtgcagaaatgtgctcagtgttgaagtaggctaagctaacaaggatgatggcctcctcctctgactcttcccatgctcaagcttttgcattaccatttctctcctcccattccaccttgtctactcctaggtgactgctcttaaaacacaccttttaaaaagttctgtttagagcattcaacagcaaagtaacaggaccatcagggaaataatatgctacttaaaaagtgacaggaggatttgggacaacactctatctcatactatattgactactcaaagctgcatagctgtgtcttacacatgcctacacaaggcttgatgaatattaatgtcatataaaaaataatttttacaaatcagctctcttagttgtttaacttccccaggaacacaaggcttaaagcaaaatttcaaacttatgctttttatcccaatgggacaaagagtgcaacactgcaaggaagtcagaaaatgcaaacttaggtagcaaaagtaggaagaacctccatgttccctttctgtttgtcattatctctccccagtcaaaatcctaaaactattagtagtagtatgaaaggatatgaaaacaatttactctccccacctatatcatactgaaactctgctttaaagctcaggagagaggtggatgctcagtgttgtctatatatccattatatatagctgaagctttgaaattaagatgattaactcatcttgaaagaaacagctgcaccaatgtgatagcaaacaagccatttttaaataaaaactcacttgaaaaaagcaagtgcatattttgtgtatgttttgagtggggacaacagagatctggactagatttaagattatacggtattctccaatagaaaaccctcttgtaagcccctcctgaatacttaagacagcagtaggcacaggggctttcaataagtacagaatggctgctattaggaaagagaacaaataaaaggagagcctacaacacagttcaaaattgataccttaaaggccataggtaatacagttataggatgtaatcattattgctggagcagtctatccccatataataaattttgtattaaccgtggataatctatgaaaagttttaattccaggcgagattttccgttgcacctctctctctcatactgtgggccatctcttactaatgcttagcctgtatttgtgttctgaaattccaagaagagggaaaagtcaagcatatgacaattctgtcatgatgattaactgctaataaatgaaaactcattatagagtacctagctttccttgatactttaatccaatgattaaaaatgtgatataaagaaatacgtaacatagactacaagctatcgtaggtctggaacatgagccttatattatattacatattctaatcctacatgtaactatcagtaaacatctttttttaaaacattactacacaaagaattccacaaagcatacattcaaacaagaggcatctaaagattaaaaaaattacccgctgtatttttgtataaaaataatcaacattctctaatgtacacaaagccaaaagataaatatagtatctgtgatgtcttcagtgacatctttagtcttctaccagctcaacacaatctttttgaaaagagcagtgaaaatgactgaaactcacggactctttttttcccctccttactcgacttctgccaaatatctgtgtatgttccttcaattactaaaatatctcaattgtggtaatataagaaaagatgaaaacaaaacattcatcatctcaaataaaatttttgatgtccaggactataaagctttcagggcttccacaaacaattttgttttagtgtcataattctatagaacactgttcagtaaaaggttttgctttacatttttttcctcaaacatgtacatacaaaattatatccgatggttcaagagaaatcacttggtaagtgctttgcaggaagcatgcaaacgtttggtaaaggaagtaggaatgtgcattctagctagtcccagcatgttcaacaatagaaaaaaatccaaagagcaaccacgtatctgctacaaactattttcttgccagaaaaggctgtgcactagttcataggtataatcatattatgtcttcgtcagtgcagaggagcacagaggtatgaaagataatcagaatgaattagtactttctgagagttaaattatttgcatgtttgtccttattttataggacaatttgtagattttttttctttttctagtatgattaaactagaaaaaattattcagcagaatattaatgttatctgaataatacttccatcatatatgtttagtaagcttcatcctttaaaagtattcctttgggtgaaaacaatatttatcactccttctatatcagagtttctcaaccttggcagtaccgatatttttgaaccaataattctttacagtggaggggtgctgtcctgtgcattataagatgtttagaaacatctctggcttctaactactagacaccagtagcaaccctcccctgaacccacccccaagctgtgacaaccaaaatgtctcaacattgccagatgtcccctggcgatcaaaactgacctccactgagaaccactgctctaaataaatgtacaaaaactgagaggaaaacgttctcagtcaaaccaaattcttggtcaagtttggaatagaaactaactcttctcacttccagatcagtattgttcatactagaacacaattccttttttatagataaagcatatgtctaaaagacatgttttttaaaatgtacactgatttcatacgattctgtcactggactactaaattattccataatatacctctcatgacaacctttagaaaactaatagggtagaaaaaatgtataagaaaattgaatcaaaagaggagaaatgtaaatcattaaattacttttaaaaggattctttatattaatgataaacatcacctttaaaaaaattatctagtataacacatttctttgaaaaatatcatggccctctgtaacaagtctttcaatgtttcatgtaacctgtaaaattaattttaccaatgtttattaattatgaaaatgcatgatgaattattatacctgtagaagaaatgtcagtatttgatgtggagatcccaatgtgcttggctatccaccacaataagtgtcatattctagaccaagttaggcctttaccttacaagtttttgtgagaaaagtaaaactgctgttttatcaaggcttcatgttcctgttaagattccttcagagagttgatgcgtgcacagatcttcagggctgggcctagcttgatattcattgcactcatgagatggtcttctttcagcaagagaagggcctgtccatcaatctcctgtgctctgaattcatctgcgatatcctggcagcctggaatttgaccagaggacagaagttagaattaaatatacaacaattagacattactcctaacagtcacagttatgctctcactgggtctgagaatctgaaatacaggctgagaaacaaatgaaatttatttatggtagtcttgagttcactcttgaagaatagagtatttgcattctgaaaataagaattcaaaatccaggtaaagcaatttgcttggaattcttgctctaaaataatgttatagaaataattcataagagggaagtctagatataatacttccttcacaaaaaggactatggtgttacctcaaagcatgccacataacaggtttgggttaactagttatacctcatgcacttatctctgtataatatatccttcacatataggtaaagaggaaacaaaaatatgttttgtcatttaaataacaatctagaaatattttctcaagtaagtaccactttcattatcatttgtaccttatcctaatttatgaccttcacttgaaaagtacatttaaaatatttttattgttcactcgggacatatcaaatttctcaagactgtattaccaatctattgcaatgctgctgaaatgtattacgctgcttgacttgactatcactgggcttgtctccacttttgttaagaaaacaattctcattgaaattatgagcttgctggcgaatttcctgccatataaccaatattttagctctcagtctaaaccaggtgctttagcaggtaacaatgctagtatctacctgaaactcaaatgtttttactgtctaccaaattttcacatccaaattactcaataaacttacccattaagggtaaagaaaccaataggaaaggtaatcaattaagtagctgagatgagagaatataaaaatatggaagctttcttgagagacagtaaaattttaagatgaatttaagaatacacataaaaactgacagcttaagtttttctattttattcaaatcagcattctaagggaaaacacaaagaaaaagataatgaaaaatgaaaatagttacattacacttttggatgccacaattttgctagttcaattatcctttctacttgcaaatgtatcatcctcttgtttatgtaagattatgatgtcttacaaccccagcacaaagcacaaagcattataggtactgaatacataatatttgtcaataaggactgaattagtgaatacacaataaacaaaaatataatctgctatagaagagctatctgtaagagtaatacaaacattttttcctgtgtacagctgtgtgtccattttttctcttgcttatttcttttctcacgtcctctgttacttgtatctttactgtttcctatataacaactagcttttcaatttctattttaataatttctcagactttgaaaaattgacatttcaataccctctacgaaattattatgcttttgcacatttatcttataaaagaaactatagttgaaatgggattactcaccatagaaaagccccttttcttttcccagaggtagctctcaacaaaactgggcagacaaaactgactaatcttgcatctagttgtgacttcatccttctttttatgaaagaactaatgttcttctctcttcagtcttacttacaagaacacaggaaagaaaagaagagagagaaagatagggtgggacttacttagattcagaaaacaagagcaatgagaagtaatgagaactataagagctacatttgggaatagaaacaaggagttctccatgaggaaaatatgtagcacattcctgttcctctgtattgtgagattcctcttcaaatatcctcttgtaggtgaacagtaaatgtattagcaaaataatatagaacaaaaagtgttttgggaattagcacgatcaaataggaatgcattttagatcacaactttcttaagctaaccacaaaaaaagtatagttacatcagtatagaaatttaaaaaaaagtgacttagaaaaattggaagcaagtatgcttccagaatctcattacagaaaaatatattttaaaaacaattttaagtgctcaaggtatactgagataaagttctgagtttctgacattaacatctactttggtaaaatgcctggatcccggggatgtgtacaaaacatacaccaactgacacagccagtcagctgagctagcttcacctcaccagaagcaagtgtagtgcagctctcagcacaggcaaggacctctgcacatgggtcccaactgatctttcaagtgtctggcatcacttctccagctaaactcaaaataaaacaccctgcacaaaaattgaccacagtaaggttggtgaaaaggtatcacctgccactcaatactacagaataaacaagtcccaatactgatattacaaaaaccagtaaatagtcatgttttaaaaaatgattcctagtttatatgcctacagaaaaatcaaatctactgtggattcacccttcaataaacagaggacaaactgatctctgcaaaaggcagttcaccatagcaaggaaaggttaaagaagataacccgcagtaaattgaaaataagaattattcctgtagataactttttaatgcagagaaaattagaaggcggtaatttttcattctgttaacagctctgagattctggtctactgcatacaagctctaacatagtctgaacaggatggttaacaagacgatatacaaagagaagagaaaactggaggagtaaatataaatgccctggttaaagagggaaggaagcctatctcaactggaaagaaacaaaatacaaaagagattacaaaatttacaagcttgttcatcctatgagaaaagcttgggagtagactactcagggaaaacaaacagcgcttaatgagagctaaaagaagctcaaaacgaaatttacaaagtccagagaagcagaaagaaatgaacactaaggcattttctggtatgagattaccttaaactataggcattatgcagagaaaactgtgagaaaggtgatacaactaatcacacaaataagcttattatttggcctgtcaaagcagtttggaaacactcccatttcataagtaaagaagagagtcatattaaccagactctaaaatagtagtaagcaattctaaattatataatagctgtgtcctttttatgatatataatgttttctaaatacctggcaacaaaattaagtgtctagatgaactctataagacaagcattttaagttatgaggaatattaagttttatgtttttttaactcaaatgatgcaagaatgaggcaaaggaatttgcctttgttctggtaaagtagccacatggcaaaggatgctggggaaaattagcctaaataaaaaaagaagtgaaagaagaatcagcagtatccatatttgttaattatttgggcaactacttttctcaggatataaaccaactctcttctgcaaaggaaaagaaaaatttcccccaaatgaaaaatcaggctcacaaacagatcatgtgccctacctggaagagtgacactacttctgaagatgacagaatcaaagcccagccccaggtatccacatagactccaaagttaattctcaagatagctatactggtctaaaaactaaaactggtttcattagatactaaaaccacaaccaatgaagacccactgtcttctaaatacacccagtttaaaacagattctaaatccacatggtcagcaattaactcacatctaagttttcgtgggcacatgcacatgtttaaaaatcttcccatgaagtatctccactttaaacaattccatctttctttaaaagtggccatatttttttaaaacttagcatttctaaaacaagctattgataaactaatttaacaaaatctcacagaattctgtatatgaggtaaagtgggtgacggattctttacaactatcattcctaaatatattttcttgtatagcatgttagctctaagtatgcttccaagactttagttgccatcagagaaagactaattagcaacaacagctgattaattagcttattaaactgtaaaaagttagtagacaagttcaaataggatgtattcttctagaaagcttgtatcaagagaaatgatatgattcgcaataaaaccaaaaggaaataaattttttgttttagtctcctcattttccatatgcgtaaggtcaaagtgaatgacaagatttactgatttaaaaaagtatatatatacatatatgtatagtcttaacatatataactagtgtgggtctcatcatgagcaaaggtgcagctgtctttagtagccagccccttggagaaggtggatataaaagattattgttgttttaaggaaaaaagatagagacttaaggtgatggaaagagtatcaaaatgagagaacaggaaaacataaataagaaagttaccctcaatattagaatgaatataattgaatttcagctctctatttgaaaaataaaatttcagaaaggctcttgatgtttatttattgaaaagaatcaaagaatgtaccttcttttaaaaggactagcttgattttttcaaagaaaccaaatttttacattttaaaaggttttgattagctttcaaaaatgtaaaaaaaagaaaaaagtctctcttacttcattttttaaaaggttaaattaggaaataaggaggaatagaatagaaaaatagaagagcagaaaggaagaagtgtctgattcaatctctctactgacctctcgagagaaatcagactgaagagaagaaagcacctttaatatcttcaccggctgaggtgtcacagcagaagcaggactagtcagtttttatcgacttggggggtatgagaaaatacccagtagtgctgagggaataagcaagaggaaacagatcatatttcaataacaaatgtcattttatttatacatatacacagtacttctctagcccttttgtgcaaaaggtgtggatgtatctaacattgctgtgtgtgaatgcacaagaaaaatattaaggccaaagtgatgaattacataccaggcaaagaatggatgaaggcccagacatcatcaactgtccatatagatggctctgtttgtgcaactggtagcaagtcactgttctcaggcattttccgaattctcacatcccgaagctcacgttctctttcccgctcgctctgcctgcgcagacgagttgtcatagcagatggcacagaatcttcatgagaagccaagtcttcttctgcagatggataagtaattggaagctggaaaatgtagtacaagcaaaatacagcattgcactttccttgcatttctgaaaagggtattttacattgaagcaaggtttatacagacctgcctaaggatatgttctctcgctgccccatcagggccacttggacgacggccacgatgcccaagactttgattatcaggcttacgattccaacgactaagtgcaaattttttagaacagctaacattgtacctaagaaattcaagaaagaaaaaatatttaatgatatatgggacaatccatttagtatttaattgtgactttaaagtgcaactgtgaatcagtaagtaccacaatacatcattaatgaatgtaagacctcataaagtaactacactgttcaatggatttacttatgctaaaggtcaaaaaacaggctctgtgtataccataatatatctctcaatataatactggacatctataacaaggtattgtattttttcctgattacagcatgacagtgggaaactgcctgcaaaatacagaggataaccaattttcatagcagtaaaaaaaatggaaggttccgaaagaaaaagaagttatgtagtatctaaatgtttattcaatctgatttttctaagtaataacttccaaagagacattaatttttaaaagtttaatatactagggagaggatctcaagcagctaacaaaagatttttcaaatattattaaaatcaaagaatgaaaatgtaaagtggagattttaaagttacacaaggaattcattgctctcactattcagaaaatttagaagtatataactctttaatgaaagattttcttttatcacaatagactgcctagtatttttgaacatagacctttataagacatgatgacagcttaaaagaatcctatgtcttttaatggatcctaaagccctggaaccaggactggcaaactttttctacaaaggactagatggtaaatattttaagtttcatgggccatataagtttctgtcacaactacccacctctgccactgtagtgtgaaagcagccattgaaaataccctgagccaggcccagtggctcacacctgtaatcccagcactttgggaggccaaggtgggtggattacttaagctccagagttcaagaccagtaaatggcaagaccagttcaaggccaacacggtgaaaacccgtctctacccaaaatacaaaaactagccaggtgtgctggcacacacctgtagtcccagctacttagaaggctaaggtgggtggatggcttgagcccaggaggccaaggttgtagtgagctgtgatagcgccactgcactccagcacaggtgacagagccagaccctgactcaaaacaataaaaataaaaaaataaaaaataaatagaaaatattgaataagcatggttgtgttctagtaaaattttcagtaacaataacagtaaaatttgaatttcacataattttcatgtatcatgaaatattattttgatttttttcccaacaaactaaaaatttcaaaatcatccttagctcatgagcccatacaaaaaaatgaacaatgggaaagacctggcctgggtgagtttgccaacctttccctagaaagaagagtgagaagaaatgatctaagaaacaaatttctgaaaagctatgcaaagctaggaaaaatatatgcagtttcatttttacatatatgaaacgccttggtaacctattttcaaaaatctgttttgtagagatgggggtctcactatgttgcccaggtgggtctcaaattcctgggctcaagcaatcttcccacctcagcctcccaaagtgctgggattacaagcatgtgccaccacacctacccttcaaaattcctttgctccaagaaagttacaagaataaatcccaattaactttgctattgctaactattctagaaccagtatgctgacaccaaaacaaattctcctcacctacattttataaagatatcaagaggtggaaataaaaagtactatgataatgaatatgctatttttcccataaaaatataagtatcttgatagccaattcattttaccctaaaacaattcgagatcctgctgtgttcataatgtgctcatttgtgggctcagcaatgtaggtttctgatttccatttatatcaactgataaaacttctttatccgttaagaaaagaatagaaaagaggctagctttatacttgatattttgtccctaaatatttagctttccaagacagctaggcagacatgtaaatggcaatggttcttccctgacctaatctaccctctctcatccacatttccctgttagggcccctaccctgctaaagaggttcatcgaaaggatactaatgtgacagctcagcaatcatctctgagagaagactgatggcagcattaagtgttctcaaatatttttaaatagtcaagaagtttaaaatattctgaaagggagtcctttccccaaatttttagagtttttaaatcacttagaatcagataaccattgttctttcttgtggtatatgcaaactagaaaactcaagttaaaacatgagttacataatttgattattgatttatcagtaacatcaaagcatatttgaaaaacagattgacaaccaaaacaatgagcccaattttggaggaaaacacttctattatttaacttaagttttactaagtatattttggaaataacctatacgaaataaaatattcaagtaagaaattccctagatgtatgcaattatattaatttttttcatgaggttaaggttatttattttttatggatgcataatagatgtacatagttttagggtatgtgtgataatttaatacattcatataatctgtaacgatcaaatcagtgtacttgggatatccacatcttaaacatttgtcttttcttcatgctagaaccattccaattctcttctacctattttgaaatacagtacaagctatagtcatcctactgaagatcttaaatcctttgaaagaataattacctttttgaacagagaaccaatttcaaaatagtgtgcacacacttcaactttagtggtaagtatctgtattactaggatttattactggaattagggtggggttctttaacataaaccaaacttgggaattatacgattaatgaagagactaaacatttattttgttattaatactatttatcagccaggcgtggtggctcacacacgtaatcccagcactttgggaggccaaggcgggcagatcacctgaggtcaggagtttgagaccagcctggcgaacatggtgaaaccccatctctactaaaaatacaaaaattagctgggcatggtggcaggtgcctgtaatcccagctactcaggaggctgaggcaggagaatctcttgagactgggtggtggaggatgcagtgagccgagacggcaccactgcactccagcctgggctatagagtaagactctatatccaaaaacaaacaaacgaacaaacaaaaaaatactacttatctgaaataatgactattgaaaatactaattcagaaaagacaagtattttgctgtctgataatgttaacagtgtggggaatttatactacagctgtcccataagaaatctaaaataaataggatgattcaaacaaatgaaaacattttaaaacaacacaaagtaaatcaaagtatttcaataatgataaaacagctgataaaacaaatactgtttttgatactttaaggactagtattatataatcatgatgaaatcgtgatgacttcattgaagggattctcctaaatatattcttaccatcaggagattactactttaatattagattatactgtacaattgattttaagtattatgaatatgtaattttcgcaaagcaaaatctagtaactaaatactaggtggctccagatactgcctatttgtattattcttctatataataatatctaggtttcttctataatattacatattaaaatatctatagttatccttggtaagctattcaagggttttttggtttagttgcaatggctatttatctgtcctttgggaaattcaagagcacagaaataccttttggcacatgacatagtgcagaatcgttttgaccgcaaaaattcattagcatatcccattttcccacagaattcacacttgagcaactcactgtccatttcttctaatgtctctaaaaaagaaggaaacaaaggaaaaaaaggttccaaaaatttaattatgcaaattttctttaagtctatactttggttggatactgctagcaaaccaatggccctttaacttttcaatccacagccactctggcagggcaaaagccttcaaaacacaaccactgctactaattccctcttgcttctgcataaaaattacaaggagtttctttctatataaataagcataacattttaaaaggttcatcttgcttacaatccatctaaaatgtaaaaaaaaattatttataaacactgggagagaaatgaagatgaataacataggcattatcctccaggaggaacactttcaaaaagctgagggtgggatatgaattttgataaattgcactgtggagatacatagcagggaactcttaattctaactggagagaataaagatggcttcaaaatggtgaaattgtgatatgtctgattttacaggagcatgcaaaataattaactctctcgaagatctgcagtatatgataaaatatataaagatgcatatatcaggaggctgaggcagaagaatcgtttgagacaaggagtttgagaccagtgtgggcagcatagcaagaccccatctcattcatacatatatatacatacataaaattctttaaaaagatgcatatatctaattataaaacagttccttttagttatattgcattaaaataaaaactaggcttaaaaatcagtttcataattcccaaccactgatgctttttttcatcatgcttttctttaacttaatgggtgctccctactaagttagaatgtccttcttccaccctacatatgtaactatcttcaggcagtaacacaaagcgcaaagacccttccatgctaaatccccgggtactcggcaggagtcacccataagcaaacaactaaatcttcatgacccacaattttctcatctgtaaaatggggtttataatacatttcccaaagaattgaagtggcaattatatgtgtgcccaaaaggtagtaggcattaaaagtgatagttccatttcctattttccacataagaactaaaagggtagtatgacatgtaatagcgctcaagaaatactttggtaaaacttgttaaattcttaaatcaaccacattttgccattttcttgcatcatcataattcctctgccaagtcatattaaaaaaagcaacaaaagcattttactgaaaagcattttactaactaaagcttttagctgtgaactccatatgtgtgctctttctatgttactcatttaataaagactaagataaatacaaggactcagaaatgtagacatgggtggcatgtactcagtgagctcaggtactcacattacctcagttttactggggaagcagatggcaaagtgctaaattaagtgaagtagcaagaactactaaaaaaacaaactgtgaattaatatttgacattggtggggcatccaaatacattatcctgaataatgaaatcatgaactgacacgtgaccagtttaaggaaattctcaggactaccttcataagcaaaagtcatcaatttagtagcaatgaggaagaaacagtctcaaaacaagtaaattaaaaattgccccttccaatgaccttccaacggcccagtcaggagatccaccaacacattcctgagacctgaaaacataattcctagaagtactgtttttattttgtcatgcttataatctgatcttactataatctgatctgactgagaagcctatagggagacagaacttctcactcaaccaccactgccattagttccagccctgaaagagtccattcctcagggttattccaggaacaggatatgctaaaagctttgtttcaaagatcttttgttaattaacatagcaatgtccaacacctgatattaagtcagaataccttatgaaggagaaggaaatgtttttgttggtgacagagaggaaataccaaacagaaatggtttacagttaaccgaacaaaaataagagtagtataagttttatttctcataaagaagcgagggacattaacagattcaaaaattcttgttctaatgttcagtcagatttttaacaaatttggtaatattaccaaggtcactcttttacatttatgaattagaaaactgccaaaacacttttttaaaactgctgatttagctaataaaaatgggattctatggcagagacagctggtaattctccagcatccactctttgcttttctcccatagtaacaaaaccctacgaacatggccacccagattaaaaacaagtttctgccctaggtgtggctgatttgtaaccaatggcatatgactgtaaatgctcacaaattccagatggtgctctttcccccatctcattggttagaatgtgatcatgaagatcagccatcttggaaataaaagtaacattctacagatgacagagacataagaccctggagcttgagtgcccaatactaaggaactaccacataagccctggactgatctttgggttatgtcagagaaaattaaattcctatcttctttaatcaaatattattctggatctctactgaagtggccaaacctgcttcctaatctagatcccccattttctggcatgaggggaagttattttttatttcccccaaagacctgaaatcacatgaggacagcagcaaaaagaggcaatgagatggaaatcataatcagtgtgaagatataccaaggaagaccataagctactttgatgaatcacaatctactggttggagactctcattatagaaccagtctaaagagaaccacagtttatcctttatatgcttaccagaggttttttatgttgaaactatatatactactaaaaccaaagccactaaataagtgacctcaccattttacactatagtacttcctataaacactgaagtacatagtaacagaaacatgaaaattataaaattaccttgggaaattaaaactagaaagtatttaaaattttagcacattttatgtaaacatttctcccctatgaaatatattatctctacatcttcctttccttactctgatatcatatcctgctgatatgataacatcagtcctttcctttgagaacatcagtcctttccttcctcttcctgccatgactacaggtgtcaattacatgcaaaatttatacatacatcctacagacggccatcaaagtctccaaaaacactcttttattcgtaacaccttcctaaaaatcttcagtactatccacccaccttcaaaccatccacctaacttcaaacttgcttgtctaatatccaaggttctccagaaactcactctgccagtcatacttcccactacccctctaatccaaccctctactcttcactgccctctctcgaagttacctagcacttacacattcttagtgcgtttacttagtgttctaatctgaaatgttctcgctgtttatcctaaatctatgcattaaatccacgacccacttcaaatctcatttttataggaaacccaccaaactaggaataatcttagccagttttaaagttctaaattctgtctatataattcagtgtgactataccatctgtagctccttcgttacctttctgtatggagattccctagattcctagttccaaactacattaaaagctgctggagggaaagcggattgtattttacttctttatgtatgtaaataatatatacatacataacctgtcatgttctagaatagtctaacatatactatatgtccattatattataaactgaggatcacactatatgttgtaaagtttcctaagcagatttccatgttcttcctattgtgtacacagggagacacattataaatactttttagcctagaactttcatttatatacatattgtagatataggccaagaaaaaaagaatacctgcacattctttgttacttttcacttcacatgagaatgctctcagataaaatagtatgtgcaattaaaagacagtatttgagaattaaaggaaatgaaattcacaaaaacaaaaggcacaatacagaccttatttggaacctgatttaactaaataactataaaatgactttaaaaagttagggaaatatgaatattggccaggtattatataacaccaaagaattattattttgctatgtgtgatatggcattataaggaaatgtgtattattttgagagaggcacactgacgtatgtaccggtgactacgattttctttaaaacaagaagaaggaaggaaggaaggaaggaaggaaggaaggaaggaaggaaggaaggaaggaaggaacgaacgaacgaaagaacaaaagaacggaaaggaaagggaaggaaggaaaaagaaagaaagagagagaaagaaagaggaaggaaggaaggaaggaaggaaagaaggaaggagaaagaaaggaaagagaagagaagagaggagaagagagaagaaaaaagaagggtgggggttaggaatggaggaaggaaacaaaatgaatgaagctactgtggcaaaataatgttgaaattgggtgataatgttgagtctgggtgactggggatttattatacgattctaatgaatgtttgaaatttttcaaggttaacattctttcaaattaaaaccaatcaaactgaactcagaataagtagtaaaaatcaaattttaaactaatatactccttgctgttcaaataagaagtaaaacggtgattcacatgttgcaacagtttataaagagctaacaatgtcagagatgtcatccttttaagttagaaaatctgtgggcaaagacagtatctagtttgcttaccagcatgctatttcgcttaatttagcgaagtaaaggcacacagtataggctcaataaatatttgtaaagtgaataaattaattttaatgaaatatactaatacattgaggataattacttagacacaagtgttaattcactactacagggccttgactattctaaatgctactgcattaaactgaactctatcacctgaagggccatgatcaaaaagatgctcctatagaacacggcaattcagaatctcagcccaaaaaacagtaaaaactttgctgcttttaaatagcaaattcaaggtataaaataccgttttcattttcatttttgtttgctttccttcagtcattttggataccacttggacttctatttactttatttcattttttttttgagacggaatctagctctgtcgccaggctggagtgcagtggcacaatttcggctcactgcaacttccgactccctggttcaagcgattctcctgcctcagcctccaaagtagctgggattacaggcacacaccaccaggcccagctaatttatatatatatatatatttttttttagtagagatggggtttcaccatgttggccaggatggtcttgatctcttgaccttgtgatccacccacctcagcctcccaaagtgctgggattacagacataagccaccgcgcctggcctatttttttttttttttttgagatggagtcttgctctgtcacccaggctggagcacagtggcgcaatctcagctcactgcaacctccgcctctggggttcaagcaatactcctgcctcagcctcccaagtagctggtattacaggtgcatgccaccacacctggctaatttttgtatttttagtagagacggggtttcaccatgttggtcaggctggtctcaaactcctaacctcaagtgatctgcctgcctcggcctcccgaagtgttgggattacaggcatgagccatcgtgcctggccttatttcattctttattagaataaagtctataaaaaaggagttttctcgttgaacaaatgtaaccacctcttgaatgaagagtatatacttaatacaattataatatccacctgatgtcaaacatcagcatgcagaaagtctgaaacgaaacaacccagaagctctaaaattttaagctaactcactaaaatactcatttgttacttaagtctgctttaaaaaagaaagaaaattgattgttttgatactaaaattctgaattgccttctctcacatatgatggaacttttcccactcacactccttcaaaagtcaaactgacattgaagaaattagcactaatcttgctattttagttatgtgaccattgagagtctgattagctttcccattattttagtcaaatggtgcattatatgaaaataaaagttgaatacttccagtgaaattctgtacagaataaaaatccacatcctgttttaagcagtaaaagtcaaagttaaattaaagggtatcttaagtgaaacccacaaaccttcagcaatcatgtcttccatctctgtgtcagatgaattatccgcatgttttgtattattctgtagctctggctgaacacacactgaatttatcacctgattatccaaaagaggccgttttttcacaggctgttctattagcaaagaggaacgactcacctttaaaaaaggagaaataataaaatgaaacaatctccaaaaagacattcagaaatactttggtttaaaaaactcttaaaatgaaacctatttgtgataatttactagttcaactgatcagatccatttagtaagtgccttattccttgggaaaagatgaggcagagtggacatgaatggtttatttctggtcaccagcagtacagctgcttcaaagtctctgtcaaatggaacctattgtctgagtttaggcaaggagtttttgaaaaaaaagtcttaatattcagcaattctttatcttcagaattaatactaatcatccagttatcctgcactgcaaatattttggtagctcagtccaacactgaaaaacaaaggcaataactgtcagtatatttaagagttgggttttttttttaactttaaaaagtctactcaattaagcaattctctctcaagttctttgtggagactaacttttttcctttataaattttagcgttttttctttctttctttttgagacacagttttgctcttgttgcaatggtgcaatcttggctcaccacaacctccacctcctggattcaagtgattctcctgtctcggcctcccaagtagctgggattacgggcatgtgccaccgcgcctggctaattttgtatttttagtagagacggggtttctccatgttggtcaggctgatctcgaactcccaacctcaggtgatccacccacctcagcctcccgaagtgctgggattacaggcgtgagccactgcgcccggccaattttagtgttttccatacgaatgcaagacaaacaaaagatcatcagtaaatgctgacatgccagtatcctcaactaattaagatttttcatgcacaaagctttttatttgtagggttaatgatcaagacaaaattattggatgtattttctggataagaaaactaaaattcaaaatgtttaggtgatttgtttacaaaaacagaatgaggactagaactcaagtctcctgaatcctagtttagcaaactaatccactataatcacaaaagaaatggaaaatcctcaaatattaacaaattaacatcaaaatattcacttatattcagtatacttggttaactcaggaatactacctattttagaagtattttcaacaaaaacaactcagatcaaatatattcattgattcactggtgagccctcagctaatttaaaaaacagaatgactagaacatcttattcctcaagaatgctggttaagtctccaatatctgccacatatggggaacaacagcttattggacagaaacttctacatttaactttagagtataattactcacaaactttttaaacattttgttcatttgagttagatatttaatatgcctcaagtgaaattaaaatttacagaagttattgcttaaagaaaaactcacattcaatgctaagggcatacacttctcacagatgaataaatttaaatcattttccaaaaaataattcagcaatacgtatcaagagtcttatgaatatctatgtaatatgacataataactctatttctaggaattcatactaagaaacttatttaaaatgtgtatgatttatatatatagatattcctttcagaactatttgaacagtgaaaaaatggaaacctaatgtccaacaataatggaaagattacataaattatggatgttcataaagtgaaatattatgtaacctttcaaaatgtttccaatactattaataatgagaaaatactcaaatttcctcagtgaaaggagaactgtatgtaccataatcttgattatatgtatgtatctataacatatatacattatatacacaaacacatatacattaaaaccacagtatgtatatgtacatatatacaatacatatgtacatatataccacaatacatatgtatacacatatacatactgtggtattaatgtgtactgtggtatatatagacataaacatattgtggtattaatggggatcatttgccctgtacatttcccaaatcttccatttagaacatgtattagttttataatgtgaaaataaaagttatggctctcactagtgataacagataataatggctatggccatgaagtgccaggtaccatacagaataatttatgcacatttagttctctcgacaactctaagagcaaagcaccgtctccacctgacaaataagcaaaataaagatcagaaagtttgaatgacttgacaaaggttacccagtcagtatggagcagacagggaaaaaagactgttcctccatccactgtatgagaattgttataggaaatccaagtttctcacacacacacacacacacacacacacgaaattgaacacaaaaacaactgattgggtagctatctatcataatgcaagattttcacccatgaatctgaaaatccagatgactcaaaaggccttcaaaaaatttttcatatttttatatatgcttgtctttgatatattttctaaggaaaaatgtttatctctagatattagcatacaaattatgtacagcttagcttcaagttgtaagacctgtagtgatagaggaccttcattttgagcgggacattttaaagcatttgaaaaatatgattgaaggctgaaatttaggaatgagaaaatatatttgctaattacaaaccatcaattgggtagcttcagatgtaacttcagatgatttaaaataatacactttatggccaggtgcagtgggtcacacttgtaatccaagcactttgggaggctgaggcggtagatcacttgaggccaggagtttgagaccagcctggtcaagatggtgaaaccccctcttcggtactaaaaatacaaaaattggtcaggcgtggtggtgcatgcctgtagtcccagctactgaggtagctaaggcatgagaatcacctaaacctgggaggcagaggttgcagtgagctgaaacagtgccactgcactccagcctgggtgacagagcgagactctctctcaaaaactcaaataaataaataaaaataaaaatagtagtacacttcagctgtcatttcagttcccttaaaaagaaaaaatgagccgagcgccatgccatggctcacacctgtaatcccagcactttgggaccccaggagttaaaaaccagcctgagaaacacggcaagaccttgtctctacaaaaaaatacaaaaattagtggggcacggtggcgcacacctgtagtctcagctactcaggtggctgaggtagaagaatcaactgagccccaggggtcaaggtaacagtgagccatgatcgcaccactgcactctagcctggtcaacagagcaagatcctgtctaaaaaaaaaaagaaagaaaaaatataaaagttgatttcactgaataaacttccaactacctttctctaaaaattataaaaatatgtcctgaaatttttttcattttttcccttagtttatgcatctaaacttagctggcataaaattctacataaacatttggaaataaaggaagtagaaagataaatgctagattaaaatggacaactttcttgaaataaaattacaagctttttattagagaacagtaatatgtaacttttaaaataatgttatataaattacaaacacacacacaaatatgcttgctacttacaggaaatggctccaatccctcctgaatcacaaagccttcaataacatgggttaggatctgtggtttaacaatagcctgtggaggtttgttctctatactgggaatgctactgtgcatagatgtactgttactccttgtggtggcagctggaagtaacaatggaggtggtggaacagaaacatgtgagggatctgatggagatttaattactgaagcactgactgatgccacagcaggtaattccacttgctctgaaaaaaaaaccaaaaagtcatttaaaaatttttttagcattttgcccaagcaaatgaaagagaattaaggaataaataataacaacagttaatatctggtactttcaaaaactgttctaagaaccttaagacctcatttaatctgtacaataatcttctaaggtagaagcgactattatttccactttatagaggagggtagcttgctcaaagttattcagacctttaacaaattgggccaggcacaatggcgcatgcctgtaatgccagcactttgggaggtcaaggtgggtggatcacctgaggagaattcgagaccatcctggccaacatggtgaaaccccatctctactaaaaaaaaaaccaaaaaaaaaaaaaacaaaattagcagagcatggtggcacacgcctgtcatctcagctacttgggaggctgagacaggagaatcacttgagcccaggaggcggaggctgcagtgagccaagactgtgccactgcactccagcctgggcgacaagagtgaaactctgtctcaaaaaaaaagcaaaattgttcccatgagacatgaaaatgttttaagatataaacttacaaataatttatactaaaatggttgcttggttttgttttgatgtttcttaattttaagctattaaatcccctatgttcctatttatatattccaaatggtataggtggggcagtggagtactttgaaagtatgcttaaatgaaatggggtcatgaaatccacagaacaagtagatttatttatttatatgttttttggagaccaggtacatgtcgcccaagctggagcccaatggtatgatcaaggctcactgcagtctcaacctcccaggctcaggtgattctcccacctcagcctcttgagtaggtgggaccacaggtgtgtgccaccatgcctgcctggaaaatttttatttttttgagacggagtctcgctctgtcacccaggctggagtgcagtggcacgatctcggctcactgcaagctctgcctcccgggttcatgccattctcctgcctcagcctcccgagtagctgggactacaggcacccaccaccatgcctggataattttttgtatttttagtagagatggggtttcactgtgttagccaggatggtctctatctccagaccttgtgatccacccgcctcggcctgccaaattgctggtattacaggcgtgagccactcaccatgcctggctgcctggataaatttttttaatgatttttgtagagatggggtctcactttgttgcccagctggtctggaattcctagactcaagtgatcctcctgcctcagcctctcaaagtgctggtataagccacccagctggtctggaattcctagactcaagtgatcctcctgcctcacctctcaaagtgcaggtataagccaccatgcccagccttcacagcagttatatccataaattaacctagtttcaccaaataatccaccaaaataaaccgtactggaaaacctgtttaaagtcacacaaagtcacacaatctataaaaagctaaaaaaaaaaaaaaaaaaagaaaaagaaaagaaaagaaaatcagcagaaaatgttaatgtgctgatttctaggaacaaatacacaattgtacaaacatattatcaaactaaggaacttcacaaaaatcctatctcacataccaaatcttcatacatacttctaggggacaaaggatgaaagatttaaaaattctgaagtaggactgaaaggcacttttctatagaatggaaaaaataaatctatggagaactgaaacctaaattaaaattttaatgtcccttacagatttagagataagagatactttacttttaaaatataaagctgcactaagtataatttggtttgttcaagaaataatgcttgctgtatattctaattaatatctagatcatgtgcataaatgtgccaaacttatagtcctaaattttgttcaaaatagagctataaattactaactttttgaagatggtaatagctatttacataagttgtaaaaatcgaaaacatgagaaacactcatgtattacaatagaagagaaagacaattattacgccctctagatttaagagaagtatgagagaaaacccaagttctaactgataaaattttgccacaaatctgtctattctcagtatcatttactgagcaagagatgtgagatttttctacctttttgtatagatgcttttcactttcaaaaaattttaaagatttataacaactgaatctcagatggaaacaagtctatttctgcaagttagtttatttcaagatttgatgagttactgtaaaaaaaaaaaaaatcaacctgtgctttagttccccctcaaatattacagaagagtaataagtatgaggtaaattagaggaagatgcaagtctacattgtactttgacaatttagccagagagatgtgcttgtcaggatctcagactacattcctgaggaaaacatggaaagacgttcttgtgttccaatatttcagaaatgtttaaacttccttcaagtactattagtaatgcttattttgtaattaaatcacaactaaaatgtaagtttactattcaataaaactgactttttttttggtaactctaatctcatgacagattagcaataaaacttacatttctgcctttaaatcaaaactccagttaatccgcagcaacataaatccatttcagtgtaaaccacaaagatttaatactataaactttcttaagtcttatgaggtattactttgaataaaaagacaataataggccaggcgcagtggctcatgtctgtaatcccagcattttgggaggccgaagtgggtggatcacctgaggtcaagagttcgagacccacctagccaacatagtgaaaccccgtgtccactaaaatacaaaaattagccaggcgcctgtaatcccagctactcaggatactgaagcaggagaatcacttgaacccaggaggcgaaagttgcagtgagccgagatcatgccactgcactccagcctgggcgacagagccagactccatctcaaaaaaaaaaacaataatataaaactcaccttaaatattttatataagtttattgactgttttctacttttcaggaggaggaaaagataaaagaaaattaaatttccccttttatgctctctagagatttacaatagtagtgagggaatagaagctcgagagaaaagaagggaaggggatatggcacgctaaagaaagcagagagcaagggttgcctggacggcagacagggttagtggtcccataagagtttgtttccatgcctgttgtagcagtccttcttaactgaaaatgatcatgagggcaataagatattcaacagaacagaatacgtacaacaaagccggaaccaagattagtattattcagatcaggggtcagcaaactttccataaatggctgtagagtttctatggctattcaactctgtggttagtaaaaagcagccacaatatctgaacaaatgagtgtgtggctatgtttcacagaactttatttatggacaacgaaatttgaattttatatatattttcatgacatgaactattactcttcttttgttttcaatcattcagaaatgtaaaagccatcattagcttggaccacagaaaaacaagcagcaagccatgcatggtggagagcacctatagtaccagctattcaggaggctgaggcaggattacatgagcccaggagttagaggccagcctgggcaacatagtgagaccctatctcttaaaaaaaagaaagaaaacaggcagcagaaaagatctgaacagtgagcagtgtgccaacctctaatcctaacattcataaatttaaaaaaataacacgaaacatttgtgtttagtaaaatacctagaatacacagtagctttgtgaggaggcacatacgggatatttgtttgaactcataaacagcactgaaatagtgaataagaatttgaatggttaagcacaagaacttttttttaagagacagagtgttgctctgttgtacaggctgaactcaaactccagggctcaagtcatcctcctacctcagcctctgacgaagctgggactccgggcatgcaccaagaagtccaggtaagaatttttttaatccatgtctaaaagcacttactcagtctgaatcacaaacaattgtgaggaatatcatatatggcttagaatgcttcatgatttttggaaagcattatttaaatcttttgaaagaattttcatttattctaatttttaaactagaaatagtctgacacatgaatgtgaatgagcatatgaaacatgtctgcacaaatcactaaaaattagaagcctgaaatgataggttttcatctggatggtactgaacaatttataagctattgagcttccctgctattaaagaattttccaggctgggcatggtagctcacacctgtaatcccagcactttgggaagccgaggcaagcggatcacttgtacccaggagtttgggatgagcctgggcaacgggatgagaccctatctctaaaaaataaaaaattagccaagtgtgctggaaggttcctgtagacccagctatttggaagctggggcaaaagaatctcttgagcccaggagataggggctacaatgagctatgattgagcctggatgacagagactgaccctgtctcaaaaaacaaccttaaactcaaatctgtattttgttacaattaactaccataacaaattcgtttaatattatctctagtgaataaacaggctgggtgcaatggctcacacctgtaatcctgacactttgcaaggccaaggcagtaaaatcactaaaggccagtagttcaagaccagcctaagcaacatagtaaaacctcgtcaccataaaaaataaaaaatcagccagctgtaatggtgtgcacctgtagttccagctacaaaaagggtgaaaggaggaaagggaaaaaaatcaacttttcctattattaacatttatcaaatagaaaaattcccacaaattttggtattttctcacctaacaaaggatgttcagaagtcaaatcttctcctctccccactgttatagctgctggagacaaagtgggtggtggtggggttctatccatccggacacattcatctgactcttctggcatttcttcttcacacacatcttctacctgataaacctgcaatgacaaaccatactgccttaaaatgtttccaaaactatattttatcaggtgttcttaatttcagaaaattaaattctatgtgtattaaatttaaaaacaaggcaaaaatgactactctaacagactgaaaggaaaacttaaaaattgctcgaatgaagtttttcatatttcttcataatatttgactgaaagcaagctgtggatcagtatctagaccaaaaatcaccaaggtttccaaaaagatggtagtcaagtctgaaaatattttttatttcgataattaaaaaatacaaataaaataacgattttgggaattcaactgtttttgttaacttctaactgtcatgaatcaaaacagatactaacatttttcataagcacactaagcgaattcctacaatgacacactatattaggacatgtaggattctatcccaggctcttccttattattatgtaatttaaagattaaattataaaaagtaacatctgagaatctacaaaaaaagatacgcaattatatctctccttttctgttctactcaacaatctaatgactctttatatataatatgcaaacagaaaatatctttccttgaaatgcatacacacacacacacacacagcctaagctctttgacaccttatttttttactctttttataatgttccatacttatgggagaaagtttttaagtctataacttaaccaccttgttatccaattgtaaagattatacttaagaaggaaaatggggccaggtgcagtggctcgtgcctgcaatccagcactctgggaggctgaggtgggtggatcaccggaggtcaggagttccacaacagcctggccaacatggtgaaaccctacctctacttaaaaaaatacaaaaaattagccaggcatggtggcgggcgcctgtagttccagctacttgggaggctgaatcaagaacatcacttgaacctgggaggcagaggttgcagtgagccaagatcaggccattgcactccagcctgggtaacagagtgagactccatctcaaaaaaaagaaaaaggaaaatggaatcgaaggcaccctgagaaggagctatgtaactagaaatacttttttttttgacagagtctcgctctgttgccaggctggagtgcagtggtgcgatctcagctcactgcaatctctgcctcctgggttcaagcgattctcctggctcagccaccccgagtagctgggactacaggcgcgtgccaccatgcccagctaattttttgtactttttagtagagacagggtttcaccaggttggccatgatggtcttgatctcttgacctcgtgatccacctgccttggcctcccaaagtgctgggattacaggcgtgagccaccgcacccggccaataccttattattaatgtttccatttcaaagaacacttctagaggttgacatgggtattttaatttaatttgttatcatttattatttacttaaccattatttatgaaaaatgattactaaaaataaagccataagagttcatttcccttcttttatctataaagcttattacttaagtttacaaaaattatgagtttttaaaatcttatttaaccatactgactaatcttcccattaaaaaagtgttttttgagaaagggtctcactctgctgcccaggctggagtgcagtggctccattatggctcactcagccttgacctccaagctcagcctcctgagtagctgggaccacaggtgttcactaacacacccagctcattttaaaatgttttttgtagagatgaggtctcactatgttgcccaggctggtctcaaactcctgggctcaagtgatcctcctgccttggcctctcaaagtgctgggattataggcatgagccactgcacacctagccccacaaatgttaacaaacaaactttcaacattcacaagaaacctttcagcaacatctaatattgtgtacatttttaatcaaactattttaaaagtctgatgttttaaagtatataaaattatacataaaagtgatcaggatttctgaaaccagcaaaacccatgtgttgtaaaagggacaatcaagtttcacctataaggatataacagtaagttataaaggtaacaataggtgacaatcaaaaataaaataaaataaaataaaaatctttccaaggctccactaagaataaaacatcttcttttgtcttttgtacaactttaaaattctactgttactggataattttatatcaaacataatattataccaaatataaaattcagaactgtgatctgaatcagctacaaagtaggcaacattttttaaagttatttgctcacaaccctgcacctggaaaccagttacactaagagagattctgtgcctcatgcctgaatctcagacgtgaaagcagtcatttgttattgttcggagcaacaattatactagatcggttcatgataataacagttttttaaatgatgataatgcccaatataggtaaaatcattctaaaaagtgtctggggggttaagaaaaaaaatctagtccccaagggcaagtgctgtcacagtgaatactttaatttgccttagtgtcagagatgttaattcagagataattaaacaagtatggttttatcgaccagttcaattttatctatgtagcattccttcagtataatagatagtacttttcttccaaagaacatgatctttgcttaaaatgctgaaactctctttaatcctaatgcagttacatgttattcaaacatctgctagagtatcttttaagaaatcaaagcttgatcatacatagaattctgatttttaaaaacaagagtttaaagaatgaaaagagccataacacaaatagcatattttgaaataatccatcaaatactgtaaaatactttccactcattatacttaaagctaactatatgtacttccagaactctcatataaaggcgaaataagtgcatgaataaaagaagtaggcaaaaacaaatctgtcacagacatctggcacaatcagcattaacaaatctaaatgttcaacaattaaaatgttgaaaaaagcaaagtggaggttttgctcactcacaagatcattaggaaactgcacatcacaattactgtttagctcataactataactattctaaaaataacaaagactgccaaacttacctcaataaagtccaatattcccatctgtttccctttcctaaataaactgaggaatatttgtttattagttctaaattatctaccctcaacatacttatatccaaatgtcaacaaaaaactttaattcttaagtatcttaaaaaacatactgattttactttgaaaattcacccttatctttcaaatttccacatctcttaaaaaatacatctttctacctttaagtgtttgaaacaaccagaaaaatataacctgtgaagaaatgtgtttgaatggaaaaaataacacatttggtcaaaggtaataaaaaaacaagcttaataaattattaaagagctatgttactcaaagaaaggtaaaagattaaaaaatatttagaaaggtaacatggaaacatccatagcaagcattataaccatatcagtgatagcagagaaagttattaatatcattttttaaacttccaaaaatgttttaaggtagaagtgcaggaagcaacaaaatatttttggctttagttttcaaagtattatgctccatatgtatatatatatatatatatatatatttttttttttttttcctttttcttttttttgagacagagtctcactctgtcacccaggctggagtgcagtggtacgatctcagctcactgcaacctctgcctcacgggttcaagccattcttgtgcctatgtctcccaagtagctgggattacaggcattcgccaccatgcccagctaatttttgtatttttagtagagatgagtttctctatgttggccaggctggtcttgaactcctgacctcaggtgatccacctgccttggcctcccaaagtgctgggattagaggtgtgaggcaccacacccagccttatatttctatcccaaatttgttcctctatagcttcccctaacataaacaattaaaaatatataaggactataaagaagtttttttttgtttgtttttatttttaaattgtattttttttcttttctattatgccctgcctggaaactgccttattttttactggttaaaaaccaaatcactgaactaggtagtgagaaagtaatttaaattaaaaattttttgaaggtgctgtacgcttcctatacccctgtttttgttacaatatccatagtaaactccaaaaatctattgaaagaaaatatagacatgataactgaatgataaactttttaaaaatttttctttcctttttttgagacaaagtctcgctcagttgcccaggccgcaatctcggcccactgcaccctccacctcccaggttcaagagattctcctgcctcagcatcccgagtagctgggattacaggcatggccaccactcccgggtaatttttgtatttttctgtgtagacagggtttcaccctgtttgccaggctggtctcgaactcctcagctcaggtgatctgcccacctcagcttcccaaagtgctgggattacaggcgtgagccactacacccagccaagttctgcttttaataaaaatttacagaaggtataattcaatctctgtgcctattaagatcagtaagaatgacaagaatacaaaaatctatacatttgtatcatgagaaccaaaatacttttcattaaagaacattgaggataatccaagtatgaaaagaaaaaacaagtattaataataaaaaatacttcgaaactcctttctgagctaatatttattagcttttaggtgataaaatctcttggatgaggtgtaatacaaaacctccctttaggaagattcttctcctcagttacaaattatgaatttgatccttctgactaaacaattagagaccttatttcagttttataaatcttaaaatgtcttttagagaatgtttaaagaaaagtatttttcaagataatttttctttctaggcaacaattgtttttagaggtttattcttaaaaatcccactacaatctcaattattcgaaacttttactcctctaaatggattttttcatcctcagtattaaattcatctaccaagattttttgacatttttaagtgagaaatattttaagtacatatttttccttagtagaaataacaaaccattaagtttaataattctataagatggcctacagttaaatttttggcaaagctggactctctcctagaataattttttttttacaaaatttcaactacaaagtataattttaccaaaaaactacatcatataagcatatctccaacttgaaacaaaatcccctaaaagcccaagactctaggatgcataaaactaaaagggttaggctagataaaccatacgttttgagaacatacaagccaacagaagggatctatgaaggataatcaccttaagagaaaaaactttgtgcagatgacactggttcaaatgcattcccttggggaaaaaaaatcaactctgtaaagatagcagatggatttgtttaaatagtaataaaattaacgagggactttaattaccatcacaaattataaagcatgcaaccacactaaacaaacaatggcatttttttttttttgcccatacagcatgtttgtcagaatactgacacatggaaatttcaagcttttttagttcacaggcatttagatcttgcaataaaacatagtgtgggaaaaaatagtttttactttcagttcagcaagaaagtcaaagagcttccaagggcttaccactggtggatcaacaggtgctggtggttgcacttgtaggtttaccgcaacagtctgtggaggaggaagagtctgaaatggcaactggaccaaagcttctgcagctggaagttcctcttctgacaccaaagcattctgcaccaaaacctggccctgggacagaatttcaggctgcacttgtaaagactgcatagactgcaagggcagtggtggaatctgagctggaggagatgtcgacatctgtggaggacttgcaattgggattggagaggactgcagggatgaatattgctggtgtgatggagagacaatctgctggcctggggataccaaggcagactgctgaactgggccaatgtgtacaacaggggaagctggaagtggaagatgggatggaagattcaactgtgctgtagcttgcacctgattagcagtggactgctgcaaatttggccctggctggagagctgatgacacaagagggtgtggctgaataagtgcttgtggatgaataattatagtaggagactgacttggtgaatgaggtggtggaggagacaccactacagactgctgtgctgactgtgactgattaggagacactgttaaaggagagggatgactctgaatcggtgaacaatgctgtgactgggcattactgggagctggaggaaggccatggttctggagtggtatacagtgctgggatgggggtgggtcttgagttgaattctgaagtgtgattggctgaatttgctgttgctgctgttgtaatatcagctgatgatgggaaactttggaaggtggtgaatgaagaggaatctgctgatgttttattagagaatgaggctgaattggagaatatgaagctgtgagagaaaaaaatgacaattagtactgatttcaaaaatacagaaatttttaaatcactctaaaggaaaaagtgttcattatcagaaggtcataatcatcagaattctattacaagttttccaaacaagagtaatttgaaaaaaaaaaaatttttttttttgagacagagtcttgctcttgtcacccaggctggggtgcagtggcatgatctcagctcactgcaacctccacctccctggttcaagcgattctcctgtctctgcctccggagtagctgggattacaggtgcccgctaccacacccggctaacttctgtatttttagtagagacggggtttcaccacgttggccaggctggtcttgaaacctgacctgaagtgatcctcccaactcagcctcccaaagtgctgggattactagcgtgagccatcacgcctggcctgaatatttaatgacaatttatagttggaaaactagaaaatatcataaaatacactgtactgtgataagttctaaaagaaaactgcctaaaacttaataatctgaatctatacatggtttgttcttattatattttataggtcacctgaatatctacattaacttttagcaaagtttatacacttgaatttcttctttgcaggaaaagaggagtatcatcatagaacaagtataacatatataaagataacttcaaaatcataaaaatactatattaaaattcataaaataaagatctcatcctttctaatccatatctaaacgtgcttccaactaatagggtaattacttataaagcttcccaaatgagtttccatttttgagctgagatgagggtatatatatcatttgacccaggaagagaaaatattttgtataataatctaatgtgattaagcaaaagacgtgtgtgaatcctgtagcacagttaattaatcactgtaactaagaactcaaatttaggggccattccaaatctaggaaaacactagttttgcttgcagagaatgagacaatcagaagcccatgctacctaaataagggattttgttaacccttttccctcaccaaaaaaaaacttcaataattgatgtgacagtatgaggttttctccacaaagaagccactcaacaggaataaatatatgtaagaattagcacagtcaagtggtagggagccccccatcatgccttttctgcaaactggtggcacatgtttatagaaagggagatgctgatgaaatcctaagtaagaatggaaactgagttcacaagaagataaactgaaacaattgcttaatgttaatatcatgtaaaaattacacacatttaacacagatttaaagacagggcaattttttttttcctaaccttggaatattaggagaaagactatattataccttacatctatttttgtgttcaaccacatttgtgacaactttataaaaactttccacaactttttaaaaaaaattttcacatttggttattatttaaaatttttggaatcctttaaagaaattaacatctgattaacatccaaaaaagaggcgtttggaaagttcaataaatatccactaattgttaaaaaaaaaaaaaaaaaaggaaatcaagtcaacaaaataattttcatataagtatctaggctagtacttcacactaagactgaaaattttatgtcagtcttttaaaactgtgttgatatagactatgctaaacagtattcaaaaagggtaaattaacaaaatcttggatttctacagcgtgcccttcatccaaggggctgaaagtgctttcacgtgtctctcattcatacttacaaaatgcctgtggtataggtgggtattattatttccctcttacagataagtaaatagatttttttgcaagcataacagcaagggcccacttcaattcaattttgtaagtaaagctttaatttaaatttaccatactgttgaagtaccagtatggtactagaataacaattctggctgggcgcaatggctcatgcccgtaatcccagcattttgtgaggctgaggtgggaggatcacctgaggtaaggagttcaagaccagcctggccaacatggtgaaaccccatctctactaacaatacaaaaattagccgggcttggtaacacacgcctgtaataccagctattactcaggaggctgaggtgggagaattgcttgaactcgggaggcggaagttgcagtgatctgggatcgtgccattgcactccagcctgggcaacagagggagacgccatctcaaaaaaaaagaataacaaatctttctatgctctggtaagtaagcaatctttttatatcttagagctgtgacaattcaacagattagcaatctatcctttcatctaaattacatttttctttgatcagaaatcaaagtgtgtttatttttagtccataagaccaattgataagcacatatattacagaataattaggtggctatgtgaagcaatacctctgtaaaagaaaagacctagtgctctgggaaaaaaaatcctatcatgttggttaatttctctgattttaataaacatcttattgtcaggatggctttaaattcagagaattaatggctgacatctctcacatatatatataattctattatttacagtaacacatattatttcacccagtaactacaacaaccccatgaaggtgatagggtactataccaatccaacatacgacagatgaagaaactgtgagtagttaagtgacttgcccaaaatcatctggctattaaggacagcattaggtctaaaagaacctatgatcctaactgagtctagggccctgttatggactgaatgtttgtggcacaaaattcgtatgctgaagccctaactcccaatgtgtatttgtagatggggcctctaaggaagtaacaaaggttaaatgaggtcatagggtggggccctgacatgacatggtttgtgcccttttaagaaaagacatcagagagcttctgctccctccacccaccacacactcaaggccatgtgaggacatctgcaagccaggaagtgagccttcaccagaaactgaacactgccagacctcgatcttgggctttccagcctccaggactgtgagaaaattaatttctgctctttaagccacagtctatggtattttgttatggcagctggagcagattgattaatacaggaccttctcactacacaatgaattaatgtctacaaaaaacagtatatattttttccaattaagctagtttcataaaagctctaaaaactgtgatagaaaaacttcagctctaatacagttcatgtttccaaacatttaaagtttgaccttattttacatattaaaaatagaatttactatgtatcaagtggaaactccaccttcaaaaagaaatgataaagaaaaccaagttactttggcaccctaaaaatacatataagaaaacaataaccatgtatactataataattagactatactacattagaatacaagtagatttttttacatttaaaatgacttgaaggaacatttttctaattgaggacaaataatcaattgagaatatctcaaaatatcttcgcttcagattaacttttttttttttttttagatggagtctcgctcttttgccaggcaggagtgcagtggtgtgatctcgactcactgcaacctccgcctcccaggttcaagcgattctcctgcctcagcctccagagtagctggaattacaagagcgcgccaccatgcctggctaatttttgtatttttagtagagacggggtttcaccatgttggccaggatggtctcgatctcttgacctcatgatctgcccgcctcagcctcccaaagtgctgggattacaggcgtgagccaccgtgccaggccaagattaacttcttaccaataaaagcagaaaaactaaaaaggtgaaaaatatagctatagccttaatagaagatatgaatggctttgaataactgcagtgtaaggcttaagaaacttttaagtagttcaggattttctgcgtggtttgtttataatcaacaacatcaaggaaaattggagtatatgtaagatctgaatttggacttaaaactgacctgagactctggtggttttggcttactggtttcctccatacttacacaagatattgaccatcagaggaatgcaaactataagcatattatcacactattaatgaaagaggggagaataagctgcaattcagaaccagatattgagagttaagggggactgaaaaatccaaaactagatttccttgcttgaactaaccctgaaagagttcccggctttctctgaaagtaacgttctctttagaaagaaatcaatctacctttcattataatttatcaaaactgcaggaatcactagaaattgtccctgagcagtcatcctaaggaccatgggtcaccattgctccacactgtcaaaactagccagacgctggtttgaggctgagaatactctgtacagtagtgtaaaaacccagcttttatgccatacagagagcagcgcctagcacacagaggtttaaaaaaaaaaaataagaattcgtgtctaactatactacgaatatatatatatatatttttgagacggagtcttgctctgtcacccaggctggagtgcaatggggcgattccggctcactgtaacctccacctccccggttcaagtaattctcctgcctcagcctcccatgtagctgggactacaggtgccggccactacgcacggctaatttttgtatttttagtagagacggggtttcaccatgttggtcaggctggtctagaactcccgacctgaggtgatctgccctcctcagcctcccaaagtgctgggattatagatgtgagctaccgcgcccagcttgaatatatttattaatttatacattatatcaaagcctacttacataagattcagatttaacaattctaagtatagtgatacctaattagtaccaataagaaagactgcaataattcccaaaatccaagtgggaaaaaaaaatgaactattaatccaacaaatatgtacctcctacctaacatacgtaagtacgtataagatacaacttagtgctgtcaagatacaaggatgaaaagatgaatccaaaaagggattaaagagttaatgtaaagtactaacacagtgcctcacacatacataaatgcccaatattattatcttaccctcaaggagcttactatctagcagacaagctaagatcagtatataagtaactataaaggaaagagaaccagaagggaccataaaagttcagagggaggagaaatttctaactagggtaatcagacaatgccacagtattgagattcagtgatgtagagaatgctggcagtattaacacaggaaacttgagaagtgaaataggtttaagtggaatattttacacttacacctaagtataaaacaagtctttaaaaagcaaagcagcgttgtaaaaggacagaaaaaagatgcttacccgatgaggttgctggaacaaaggaagttttttgtttgtttgtttgtttgtttgtttttgagacagagtcttgctctgtcgcccaggctggagtgcagtggtgcaatcttggctcactgcaacctccgcctcctaggttcaagtaactctcatacctcagcctcccaagtagctgggactacaggtgtgcaccaccatgccctgctaatttttgtatttttagtagagatgggttttcaccatgttggccaggctggtctcaaactcctgacctcaagtgatccacccacctcagcctcccaaagtgctgggattacaggcgtgagccactgcacccgcccagatttttttttttaatgaaacatttgtaaggtgtatagcccagtgcaacacacatacacatacacacacactcaaacaatatatagttatagtgatttagaaaactatgcagctacattaagaataagggagacctaattatggttgagaaacaaaggaaaaggtctagcatgagaagataaaagacgctgtaacaattatgtactaaagaaggtcaggaaatttaaaaaaaaaaaggtaggatcaacaacaggggcaaatggtgctaagtttaagaatacatgtaactctttatcttatcaaaagtaaacaaaattcaatcctgagaaattctgagatgaacagaagagacagtaagctcactctggatggcccccacattttcagtatgagaaccatgaggcaagattatctggataaagtaaaggaagcaaaggtagaattcaaagcttgagaagaatgacagtgactcaggtgattgcctgagatgatcctctcagagatgaaatcaaaggcagaaaaagacaacaacataaggaaaataattatgcataatcctatgtttcaaagtgacaaatttctcccactgataacaactttaaacaaaatagtatactgcttttttaaaagctttaaaaattatcccactgaagtatattaaataaactacaggcaaatctttttttaaagatagaaggttttatcaatataaggagagaccagtgcttaaagatgataatcaaatgtaatttgattttaaaaaacctattatattgttacaatttattttatcttttgggcttttttgtctcttttcaagctacacattaagattaagtttataaaattcacattttaaaatgttttaaaggtgtcactcctgttcaagtcatgaacatcctttgttttgctctgtctgctaagaaaatgaataatacaactattttcaacaaaagttttatcccacctggtgctattaactggtgaatacttgatgtccgggtgacagctgtgcttcgtgattccaggcttgggctctctcctttcttattactttctggagaaggatctcgttggctgattttagaactggtcactgttgttttgttatgacaaattgtcaatgactgagtttgactagtgctttttggtggaccattctgtgagctagataatacacccaacttctggctgcgtaatgttaaattctgaacctaagaaccacataacagaaaattaggatgaaaacagatggttttaattgatgtggtcatcattaccattatgacaatactgacaacacatttatattatgcttttcatacgtaaagctccaagcacttgaaagaactgattaatccttaaggaaaggagagttattattctaagtaatcacatcttaaatattaagtggcaattttttaaaagacataagagaaaagaaaagagggagggagagaaaaaaaagaaaggaagagagggaagaagaaagggggagggaaggggaggagaagggaaggatcataaagaactaaataaaagcagtatgtatatatatatacagacagtgtgtgtattatatatgtatgaactgtgaatatgaggaaattactctgcaacatactgcatttaaaagttaccagttctagctatagagattaaggggacattaaccttgtaagaaaattaattcatcaaatcatctgccccattgtgaaaattatgaaaagcattttcaagcaactcttttaatttagtaaaattttggtggtggtgttattgaacattcactgcctttgaaaactacatctcatgaactgaaaagactctgcatgaccctgaaatggctttctatggtggctcctgctacactcagggctatatgaaacatactgccagtctggatggtagcaaggattatcccaattaatctcagctgagatttataacctttccaaacagcaagatgcaagacagaaaaatgctgctccaaaagttgctgaacttcttgcctatctagaatgaatgtatcaaatatatgcaggctagcactggccctgggagagaaactgaaataaaagagactccgaagtgatcaagcaaatgatatactgctgctttataaaaacattcttcagtttcatgtgtgttccgtctctacatcattaactgatgctcaaaagctataccttctcccagcactttgggaaatcgaggcaggcagatcacctgaggtaaggaattcaagaccagcctggccaacatggtgaaactccatctctactaaagatacaaaaattagccaggcgtggtggcacgcacctgtagccccagctactcagaaggctgaggcaggagaatcacttgaacccaggaggcaaagggtgcagtgagccagatggcaccactgcactccagcctgggcaacagagcgagactctgtctccaaaacaagctgtcctttctcaggctgggtgtggtgcctcgcacctgtaatcccagcattttgggaggccgaggtgggtggatcacttcaggccaggagttccagcctcaccaacacggcaaacctgtctctactaaaaatacacaaattagccaggcatggtggcgcatgcctgtaatcccagctactcgggaggctgaggcatgaactgcttgagcctgggaggcggaggctgcagtgagccaagatattgcgccattgcccacaagtctgggtgacagagcaagactctgtctcaaaaaaacaaataaataaataaataattttttaaaaaagctatacttcaggccaaacttttcatcagttctattctaagctactcaaagaattttctaattgaaaccatatggagtgtcttctctgatttttctcaaatatttcataccaatgtaaacataaatggactaataaccactgcattattaaagtttaacgcaaaaacaaaatatactgactgggtgtggtggctcacgcctgtaatcccatcactttgggaggctgaggcaggcggatcacaaggtcaggagtttgagagcagcctggcctatttggtgaaacaccgtctctactaaaaatacaaaaattagccagatgtgggggcaggtgcctgtagtcccagcagcccaggaggctgaggcaggagaattgcttgaaacccggaggcagaggttgcagtgagctgagatcacaccactgcactccagcctgggcaacagagcaagactctgtctcaaaaaaaaaaaaaaaaaaaaagataagaaaaagaaatattagaatctagatttctcagattgccactcaaagccctccacaacctaggccaaaacccacttcaagcccccagtttctagtcctccagcctacagttctcatattccacccaaactgttctgctcactattccccaaatataccttccacttccttcatttggagctcttattcaagcacttcttgactaaatgccatcttttctcaaagctgtcttttgaagccaaacccattcttccaagcccagtaaaatccctctttccctacttaagaaacattctgaaagtccctggttagaaaagagtttcttccttctagaacaactttcccatagcatttgggtcattactggcctatagcacagatgaatatctaacttgttttagaattactaaatgtatgtttgtctgtgaaatactgagactcgctagtagactctcatctcaacattcatttttatactccctgcagttcggtgctgcagacttaacagatgaggtattctcctatatatgattttgaaatatatattacatggctaattttttggtaagcacttagttctcttcatcgtgttcttaggctaacattaaaatctgttcatgtttaccaaaaacatcaacaagtatctagaagaggcacattaaaatcttccaggaagcaagagaaagacaatataaaatttaacatttgacacaaatgatctataaagtagactgcatagtaatgataaccaaagggtaataatctgaaaaacctgaaatgaaaagtatattcacagtaaacaaggatttgacacaatgaacccgaaacctgcagcatatccatttctatagaataatactccttttgtttttaattttccttttctggaattctgaaggaaaatgtttatatacttacatacactatgttgtatatatattatttatgtgaacatatatattttagaatatggttaaaatatctatgatcattttgacttaaacattgacatggtttaaataaattccaaacatgaacgctacactgccaaagtatattacaaagttaatttagctgttagtgaaaagataacatatacggatttccttgacagagcctcccttttgaaagaaaacccatcctttctaagaagaagaatattagggcactctggtgtcccacattcatttcatctgaacctttcctttgatcaagttatgaaaactttctggcttttgaaaaagtctacattttgcctgagttatttttgctaatttcacatctcacactgttatagagggcttccctgccaaaatactctcacatcaattatttaactggaatctaacaaatactatggcaattatcatagtatccctaagagtgagggtcacattgctgacagtagagctgagtttttagcttttaaatccaaagggttgtttttttcctcaattctaagagtattccccagatagccttactggggaatactcttagaattgaggaaaaaaacagccctttggatttactgggtcagatttctttttcttttttactttttttgagacagagtctcactcaggctagagggcagtggttcaatctcagctcactgcaacctccacctcctgggttcaagcaattctcctgcctcagcctcctgagtagctaggactacaggcttgtgccaccatgtctggctaatttttctatttttagtaaagatggggtttcgccatgttggccaggctcatctcaaacttctggcctcaagtgatccacccatctcagcctcccaaagtgctgggattacatgcgtgagccactgtgccagcctctgggtcagagttcttactcatttctttttctttttttttttttttttttttttttttgagacagaggcttgccctgtcacccacgccggactgtagtggtgcgatctcggctcactgcaacctccacatctcgggtgcaagcgattctcctgcctcagccttgcaagttagccaggctgtttacagatacccaccaccacacctagctaatttttgtatttttagtagagacgggatttcaccatgttggccaggctactctcaaactcctgacctcaagtgatctgcctgccttggcctcccaaagtgctgggattacaggcatgagccattatgcccggctcatctcttaacacactctgccctataacatctttccaaaaatctttttttatgtgggtgtgcctggtggggagaaggaatggagcatttaacatagtaaataaaagtgagatattccaaatttctcatttttacactatggtataagaatgtttaatactaaggaaaaattaactgttgtactgacttctatagcttaaagaatattaaaatacaacttcagatttggtatttcacaattaaaataaaaattttaactgcaaatataattctaaaactcaacaaagttatgcagaaattttccaaaacagtcttgaacttgacgaaagttatcactggaatgcataagtgtgagcatcacctaccaatgccagactcactcactgccatttcaaaagcacagagaagagaaacaatatccatagagaaattcctaaagttcaatccattcctctagcccctcaaaaatctatctttgaattaagtccgatcacagaggctcataattagaacacatcaatctggaccccaaagaccacttttataaattattttgactctattcacattaaaaatacctttaaatatgaagtaagatgttttcttcatgagtaccagcaagaaaaattgtgctcctcagaacatgttaaaatcagctgtgttttcctaagcagctggtttgtttgtttcaccttggaaactataaattctttttttgttttgttttgtttttgagacagggtctcactttgctacccagtctggaatgcagtggctcgatcttggctcactgcagcctcgacctcctgggctcaagcaatcctcccacctcagccccccaggtagctgggactacaggcccgcaccaccacgccctgcaaattttttgtatagatggggttttgccatgttgaccaggttggtctcgaactcctgagctcaagcaatccaccagcctctgcctcccaaagaactaggattacaggtgtgagctacctcgcccggcctgtaaattctttaagtggttgcttttctcccttcactattagttacctgaaagctaagaaccaactttgtgacttatcttcagacaatgcataacaaaaatagtagttagcagcttgtgatatcttatgtggaggcactatgttaagtactttttgtttcatttattccttataacaatgctgagctgcaagtaacggctccgagaatagagctgagttgttttaaggaataaatgaaacaattcagtaaatgaaacatttagtaaatgctatcagacacttctattttaatttattaacatatttaatcctcatagcaaccttttgaaatatattataaatgttattttattttatataattgaaactgaggtgagaggttaaggacttataataataaaatggtagagcaagtatttgaactcagagattccggctccaaagtccgtattataaacactatgctatactatgaatttgaccaaaatcaatctgctggcaaatgttgttgctgaaatcagaatttgaatccaagtcttcctatccccgacttttgcaaaaaaaaaaaagtactatttactgagtgcctgtaaatgttttatacactaaagatacatattactcatccttttaccctacaaatatgaatgaatattagagatgtttggcaacttgtccaagtcatacaataaatgactgaagtaggagcttaagtccacacagaacttcatacatgtaaactgagcagcaacttcacgcctagctccatgccactttcctagttttatttgtgtcttttttcttacatggttccaacttactttctgatattttactgtatgcaccttgtaaatgaattaaaatcttagttggaacaaagccaaatataaatgaaaaaataaaatttaaaatgttctggaagttgatgatggtctagctctattaggtttcataaaactaaaacaaaaaaaaagaagatcattatttcaggctggcacagtggctcacacctgtactcccaaaagtctgggaagcctaggtaggcagatcacttgagctcaggggttcaggaccagcctgtgcaacatggcgaaaccctgcctctacagaaaaaaatacaaagactagccaggtgtggaggcacacacctgtaatcccagccactcaggaggctgaggtgggaggatggcttgagcccagggaggtcaaggctacaatgagccatgattgacccactgcactccagcctgggtgacagagtgagaccctatctcaaaaattaaataactaaataaatcaatcaattaatttaaaaagatgatcattacttcaacatattcattccacagagacataaaaagtttagagctgaaaaatcttaaagttaacagagataaagttctcattttataaatacgggggaaaaaaagtccaataaagttaactgtagagaatgccagggcaagttagaagaaagctggatttaaccgaccatcatctttataaattaatacatgaaaattagcctttacttgtaaatgaaataatatatagaggttttatcaaaaataccaaggaatattattactacctcattttttattttttaccagaagattgagaactattatattacaaataagaagccaaagatgaccctaaaatacccatttctgccatatgcagtctaaaatattcattatgaagaataccagaatacagcaatatcatgcaaagtaacactctaactcaattgttttcatttaaaatgtactcactctaattcattcttgtcaaatttattgaggtgtaacttacatacaataaaacaaaacaatgagttttgacatatctatataccatataattactaccccaaccaatatacagaacatcaccttaatcatggaagttcactcatgccccttcccaatcaatctcctcctactttctaccccagataccactaatctgattgtttttcactatagtttttcctgttctagaatttcatataatggaatcatagagtatgtatcccttataccaagaaccttataccaaggttcttttgctaaacatcatgttttttaagattcatcagtatttctgagcagtattccactgtaagaatatatcgaggccgggcgtggtggctcacgcctgcaatcccagcactttgggaggctgaggcgggcagatcacctgagattcaagaccagcctggctaacatggtgaaaccctgtttctacttaaaaaaaaaaaaaaaaagaaaaaagaaaaaaaattagccaggcgtagtagtgcgtgcctgtaatcccagctactcgggaggttgaggcaggagaatcacttgaacacaggaggtggaggttgcagtgagcggagacggtgccactgtactccagcttggtcaataagagcaaaactctgtctcaaaaaaaaaaaaaaagtatatatcaaaatttgtttatccactcagcagctaaaggacatttggttgtttccactttggggctattctgagtaccgctgctataaacattcatttacatgtctttatgtgttttcacgtctctcagggtaaacataaggagtagaactgctgagtcacacgttacatgtatgtttcactttaagaggaactgtaaaactgtttttcaacatgtggctgtaccattttaccctctcaccagcaatgtatgagagtctggatgctccacattctcaccaatatatagtattagcagtcttcttcatttcagccattctagtgagtgtatggtgatactcattgtggttttgatttgcatttctgtaatgattaatctcactgtgtcacccagactggaaagcaatggcactatcctagttcactgcagcctcaatctcccaggctcgagcaatcctcctgcctcagcctcctgaaaagctggaattacagcagcgcagcaccacacttaaacaattttttttatttttagtaaagaccgggtcttactattttgcccaggctggtctttaatgcctgagttcacacaatcctcctacctgggcctccaaaaagtgctgggattacaggcatgagccactgcacctgaccaattttttaaattttaaatgtgtctagtttaattcactttcaaacttaaaatccatcttgacttagttattacataaggaatactgcaaaggaatctaagcaaaagaatatatctcacatgagaaataaatctgctttatgagaaaactaaacatagaaagccattaacaaaaactctcattaaccttgaccaaccaatgtcaaataacctaaatatctgtgtttaatggtattataatttttatagaacaaaaaacattttcttgaagttctcattgtattttattaaatttcaatctgaaatgcatgacaaagagcactgaaaccatcagtaacttaaacacaaatgcaatgcttaactttaacctgaagatccagatctcaagtaacacattatgaagctagacaagctcacctgagtagctgcagactgacaggaagatgacgatgacgacgagacaacaggaatgtcagactgtacagcagccacagtggtagcgggtgtgaaaatcagctgtacagacagaaaaccaaaaaaataccctaagacaaaagaacatgtcccacacacaatgtgtagcaggcaagagagactgaaatttgtgacagaaagacaatgcagtttaggattatctcctcagcaaaaggttctacatgacaaagagaagtttctgataatagagaactcaaaaaaaatcataaacatttttgaaacagctcatgattctgatgagtgcaaaaaaaagcagtactcaaaaaagaaaatatattttggtgatatgaaattctcagaccaaattgtgtctcaaataagctattatagttaaatttttcctagctcagaactactgtggcaggattcctaaaatgggaagtaaacaactagtcactattttgggacacaaattaaatttcagtgagaaacaaaaagaaacaccaaaaaagtcttttcagtcctctttatcataaggataactatgccacatactacactccaatatttcacttagctacaaaggatctaaaggacaaatccaggttgccctttcattttaaaactatttgtaaagaaatattcattctatggccaggcgtggtggctcatgcctgtaatcctagcactttggaaggccaaggcaggtggatcactggaggtcaggagttcaagaccagcctggccaacacggtgaaaccccatctctactaataatacaaaaattagccgggtgtggtggctcatgcctgtaatcccagctactcgagaggctgaggcaggagaatcacttgaacccaggaggtggaggttgcagtcagctgagatcatgccactgaactccagcctggatgacagagcaagactccatctcaaaaaaaaaaaaagaaaagaaagaaagattcattctaaaagtaaatgccacacatgtaaaagttcaacaacaaaagagcctgcaaaaaaatcttcacatcaaaaaacaaagacatttaatttttttacttatcactttccttttttttccttttctttttcttttttttttttttttggtgagacagagtctctgtcacccaggctagagtgcagtcatgcgatctcagctcactgcaacctctgcctcccgggttcaagcgattctcctgcctcagcttcccgagtagctgggattacaggcatacgccacaacgcccggctaatttttgtattattagtagagacggggtttcaccatgttggccaggctggtctcgaactcctgacctcaagtgatccgcccacctcagcctcccaaagtgctgggattacaggcgtgagccaccgtgcccagctcaatttttttcaatattcaaacaactgccattaatctattttttcttttttttttttttttttttttgagacagagtttcactcttgttgcccagactggagtgcaatggcgcgatgtccgctcaccacaacctctgccttccgagttcaagtgattctcctgcattagcctcccgagcagctgggattacaagcgtgagtaattttttgtatttttaatagagacagggtttctccatgttggtcaggctggttttgaactcccaacctcaggtgatccacctgcctcggcctcccaaagtgctgggattacaggcatgagccaccatgctcagccaaatgccattaatttctaaggcaatacaatccactcagagattaaccaattcaatttagtaaatttgacaagttgtttcaaagaatgtgtaaatactttatttcaaaattgtatcaagggttattcagttcctcttgctatctaaattaaaatgttcaaccaaatgcggatccaaaaaaattagaaaattaaacgaccaattaagtgaccttttaaacttcagttctttggtacactaaatctaagtaaattcaacaacaaagtacaatgatgagccctccatacctatggaaggctctgtgcttcgtcattcaactatagatcaaaacaatattcatttaaaaaaaatagctgcatctgcattgaacatgtacaaatttttctcttgttattattccctaaacaatatagtataacagttatttaaatgatgtttatattatactaaatatatgtaaagacgatgtaaagtatatgggaggatatacataggttatatgcaaatactatgccttgagcatcctcagatttgggtattctaggggacagagagggtagggcctggcaacaatccaccacagacaccaagggacaaatggtataactttcctgaaaaggtaatttccagtaccaacaccctgaaaggactaaacctaaaaagaagatattcaatttagtttgacccgtatgaaactgctaattttagagttcaaaaatagccaaatagcaaccatctcaaatggttcaacctaattttaaagcatagtatgagttaaatgattggaaactttgcaattttagatagaaaactgaagatccaagccaggtgtggtggttcatgtctgtaatcccagcattctgggaggtgaggcaggtggatcacaaggtcaggagtttgagaccagccaggccaagatggtgaaaccccgtctctactaaaaatacaaaaattagctgggtgtggtggcgggcacctgtaatcccagctacttgggaggctgaggtgggagaatcacttgaacccgggaggcagaggttgcagtgagcagagatcgtgccactgcactctagcctgggtgacagagtgagacttcacctcaaaaaacaataacaacaacaacaacaacaacaacaaaaactggagatccagatatatattcagtccactggacaaaaaagaatataaatatatattagggacaatgcttttgtctagcttcttgtaaagacatcaaataaaatacatgtcaaccaatttctatattccttaaagaagctcaacaattaaattagaaaatctgtagatactcaaatacagaataaccaaattaacattcctatattcataaaatatcaaaatgaacacaagaacacaaataaccttgcagaatttgagatgggaaaaaccaaagttaagaatcatctgggagactatccggaactccaatatagaattcagaaaatcctaggatacaaattataactttaacaacaaagtttttttaacatctctatttcaccaaatctaagttgacaaaaacaggcaatgattttatggaccactgtaagtaccaagatgccatcagttataaaatgcatccaaatttcacagatattaaaatatgaaaaaaaggttttcaatgaatttgatattaaaaaataatcactcttacgttactgaatctctattagcttctcaatgtaataattactatttgataccaagaagacctattaattaaaagtagaatctttcatgacataaatgtacaagagctgaaggcacgcccgcatgcacacacacacaattaaacatttcttaaatattaaaaatacctcttattgtatcaaatcaagaaacattttgatctctcaagtccttaaacactgaaaaaatttggtagctcatatcttaccatttgagctcggagatacatttgagcttggcttgccgttagggtaggggaagtactccctagtaacatagtctgttgggtaatactgccgctggtagaactggaagcctgggaacggcttattaactgtgcaggtgtaggagaagtggagaggttgatctaaggaagaaaacatattaggtcataggcttccatttcttgcttccatgttactgaatttcacaccgagctgcagttaggcaatcaatggtataaactgtggctaaggaacccaaaggagaagcctttatctttgacagaccccctcatttctttgggcagttatttgcacatatgcaaacaatggcatggattggttagtaatcagggcaatttttttttttttaagatgggagtttcgctcttgttgcccagactggagtgcaagtgcgcgattttggctcactgcaacctccgcctcctgggttcaagtgattctcctgcctaagcctcccaagtagctgggattacaggcatacgccaccacgcccggctaattttgtatatttttattagagacggggtttctccatgttggtcaggctggtctcgaactcctgaccttaggttatccacccacctcggcctcccaaagtgctaggattacaggcatgagccactgcacccggccacagtttttaaggatagctacaacgtgtttcaataagatttctagtatcttaaaatatcatttccactacctcctaaaaattagggccagtgctcacttccgcagcacatatactaaaactggaacaatacagagaagattagcatggctcctgcccaaaaatgacattcaaattcatgaagctttccattagttttaataggggattttgtatgttctcaacactaagaaatgatcaatgatttgagatgatggatatgccagttactctgatttgatcactatacatgatatacatgtattcaaatatcaccctgtatcccataaatatgtatagttattatgtgtcagttaaaaattaaaaaagagctactgtttcattttaatattccacataacttaaaacatcctaatcaacagtttattctgtcacattctgaggagtttgtgaacaaaaattaaaacacagataatgcattcacatatataaagacatacatgtaacacataaccagtgtaaagctgtagtcaaaagctctcaagcaaaagaaaatactacttctcaaacagatggaaaaatcctgaatatcagctacaaaattaaattataaacactaaagtttaaaacttctgttaaagaataaactagagcattgttggccgggcgcagtggctcacgcctgtaattccagcactttgggaggccgaggcgggcggatcacaaggtcaggagatcgagaccatcctggctaacatggtgaaaccctgtctctactaaaaaaaaaaaaaaaaaaaaaaattaaaaaaattagccgggtgtggtggtgggtgcctgtagtcccagctactcgggaggctgaggcagaagaatggcgtgaacctgggaggtggagcttgcagtgagccgagattgcgccactgcactccagcctgggcgacagagcgacactccatctaaaaagagaaaagaaaaaaagaaaaaaacccaataaactagtgcattgttaacctctagaaggatgcgtaagaaactggtaactggttgtatctataaagagacattggagtggggtggctagggtaatagggaaaagaaaaagcatactcttttttttatctttctaattttagaccacatgtatatattacccattttaaaaataaataatatttttggccgggtgaggtggctccagcctataatcccagcactttgggaggctgaggtgggcggatcgcaaggtcaggagtttgagaccagcctgaccaacatggtgaaatcccatttctactaaaaatacaaaaattagccaggtgtgatggcacgcgcctgtaatcccagctactcagaaggctgaggcaggagaatcgcttgaacccgggaggcggaggttgcagtgacccaagatcacgccactacactccagcctgggcaacagagcgagactctgtctcaaatactagtaataataataataatatttttaaacagagaataatataatccaacctcaaatcattttgtggaacaaagcacagaatacaattaataaatattttattagaaaaaagaatactttattggacttcttattcaagcaacaaggcagactggactaatacatccatgtgaccaaacggtatcactgaaatgctagatcaacatgaaaaaatcagaatatacagcagaactccaaaagggagagaaaagctgggaaaggaaattcctggtgccagaaaggaagaaactcaaagccagagagatgtcacctcagctgacaccaaggcagtctataagggtatcttggttctatagagccagaagatccatctttgtgcttatttcaggggagggctacaagtcaaatccctattttgagccaaaatcctgaaaagagctgcccaatatgtaagaaggagctggaaaagctccacccatacgttctgagaaacagcaaagaagcttgcatctgccctgctcctagtggaggcagggaaggaggtacctatgagaatcaaaactccaggcttacaccaggtaggggtatagaatccacatccacactccctgtacggttccataacccagcccaagacattaacatctgaactaacccaggacacttgttaaactgaatggtgactggaggaagctgagtgaagtttatataggaggacctctctgtactagttttgcaacttcctatgatttataggaatttaatttataattattttaaaataaaaaagtttaaaaaactgtatagtaggcacatgacagttggttatctaattctctaaatgtatatatatcacatatttttattttaatataatagttaaatgtataaatcaatgcataaataccactaatacaatacagaattattctgtaattttgtttgtttttgttttgttttgttttgtttttttgagacagagtctcgctctgtcgcccaggctggagtgcagtggtgcgacctcagctcactgcaacctccacctcctgggttcacatcattctcctgcctcagcctcctgaatagctgggactacaggcgcccaccaccacgcctggctaattttttttttttttttttttttgtatttttagtagagacagggtttcatggtgttaggcaggatggtctcaatctcctgacctcacgatccctccccctcggccttccaaagtgctgggattacaggcgtgagccaccgtgcccagcctattctgtaatttagatcctattcctaacacatcactgaaatcaccttaacaatagtcaccaacatctaactgacaaaatcagtggaatcttttcagaccattccctctcagtcttctttaccagctcttcttttgcacccactcccaaaatgttcatgctctgtctttgacacttttcttctttttttttttgagacagggtctccctctgtcacccaggctggggtgcagtggagtgatcatggctcactgcagccccaatttcctagactcagatgatccttccacctcagcctcctgagtagctgggactacaggcatgcatcaccacacccggctaatctttgttattttttgtagagacagggtttcatcatgttgcccaagcttgcctcaaactcctgggctcaagcgatacccccacctcagcctcccaaagtgctgggattaccagcatgagccatcgcaccagaccacacttttcttcttgaattcctagattatcatatctacttccacggtttcaaacaattcaatcctgatgactcttgattcttaactataaacccttttttgaagttccagatccaaatacctacagaacacatctttctgggtatcctttaccagctcaaattcagcatgttcaaacagcaaactaattattccttttaaaacagcttctcctcaaatggcactggcattttctaaaattctccaagacacagtatctggaagtcatcctgatgcttccctctcctttaccacacacacaaaatcagtcacgtatcttgtttctaatacatctttttgtctcctaatttccattttgatttttcatcacttagtttgagactttgggcccatgtcatttctggcttgattactttaatatctgcaaactgatacctcttactggaatcttgtcaccttctacttgccagataatctttccctgattattaatattaattacccatttaagaatcttctgaggccgggcgcggtggctcacgcctgtaatcccagcactttgggaggccgaggcgggcggatcacgaggtcaggagattgagaccatcctggataacacggtgaaaccccatctctactaaaaatacaaaaaaatagccaggcgtggtggcgggtgcctgtagtcccagctactcgggaggctgaggcaggagaatggcgtgaacccgggaagcggagtttgcagtgagccaagatcgcgccactgcactccagcctgggtgacagagagagactccgtctcaaaaaaaaaaaaaaaagaatcttctggataaagttaaacctcttccctgacaacctctctagcatcatctcctccccctccacacacaaccttcccattaccatagcaaggtatgtgtagtatcatgatctcagtcctctatggcactggcgatgatattcctgactagattgagcatccttgccaccgccatgtcccagcccatctgcagctacatagtgaacaacttctcaaaaatcacctgctctaataagctttttcaggcattcccatatcccaaagcagaactgactattccccctctttgttgcctaattgttaccgtccatatacttttagcatatatttctatctcatccttctaaataataatttctttaagggtgggggccatgtgttattcatcttcatatatccagtatctacgaaaggtcttcattcaataagcttattaagttaattaatgtcatgttattttaaggcatatttcatattttaaggcatattcatgcaatatttaagctttgctccagagattaaattaccaacagggaagaactggacccaagtttttctgactcatgtattttggcattcggggtacttttttaatatcctgatagctctctagttcaggttactctgcagtaataatgccttagaacttttttttcagttggtgattctttcaaaaaacagtaagaaagaaatgtactcttagtaaggatatttacacattctctaaagaaaaatgtaataaaagtcttctttaaaaaatgattggctgatagctaacaagctggagaatgctttttaaggaagtatagtacaaagtacaaacagaatgcttttatttttcttaaaaaagaaaagaggaagtgaagacaactagcaacgccctaaccacctgtattctactctaagttgtgagatcaaagaacaagtgttgtgtttacttttaagttccatataacaagtaatatttcaaaagcagctatctactaataacacccaactcatgaaggccaacagatcagtagccacctctgcaagaagtccatctccctagctagcctaactaaaaaactgtccttcctttccacaactgataaggctctcctttttcctgtgttgctctgctgacctaaaccagatgtctttaccagtttccattaatttctctgtcagttccatcccaacactcctaattccctttcactgaagaccctgaccaatcctgtcacttcatatctcaagtcacactccacaaagaaactcacttactgagcccgattactgcaagctgtctccccactgacgctaattctaggagtcaccagaaagaaacaagtctgccagaaaaagccacttaactcccaactacctgttaatgtcctcaaaaggagtttccaaccgattactacccatagccaaagtccatttgagagttgcctctaccgtttcactgatcagaatcaatcaggtataccctaaatagagaaacatttcacattaaaagaatgatgtatctgtattcagtggcattaaaagatttttgtgtccactgctgagtaaaaaggcagcaaaacaacatgtagagtatcattcatataggtacatacaaatgtctgtgtgtgtatatgtatcacaaatgtgaaaaacatgttaagaaagatggccaggcatagtggctcatgccagtaatcccagcactttgggaagctgagacaggtggatagcttgagctcaggagttcgagaccagcctggtcaacatggtgaaaccctgtatctaccaaaaatacaaaaaattagccaggcattgtggtgcacacctgtggtcccagctactcaggcggctgagctgggagatcacttgagcctgggaggcggaggttgcagtgagccgagattgcagcactgcactccaacctgggtgacagagcgagaccctgtctccaaaaaaaaaagttaagaaaaatgactgcattggatatacacacaataatacatactcataacatgatatatgactagactcaatatagaaacacacacacacccatgcaccactacctgtgagaacagtcaccaaaatgttaaaggtgtatatatataatgccttctaggagtaaaatccgggattactttttttaaagtttttaacttttctatgtagatattaattttagaatcagagaggaaatgctatttttctctttaatgcttaccttagtatattaatttgcttttatcatgttaaagcagcttataaatagtattgcctcattatttagtgggaactgctatgtggtatttcaagtatcagtagagtaaaatgctatatagaaattttatttttattttattaagaaaagagatggggtctacgtagttcaggctggtctcaaacttctgggcttaagtgattctcccatcttggcctcccaaagtgctgggattacaggcatgagccaccatatccggccctatgcagaatttttttttttcttgagacagagtctcactctgctgcccggactggaatgcagtggcacaatctccgctcactgcaacctccgcctcctgggttcaagtgcttctcctgcctcagcctcctgagtatctgcgaccacaagcgcccactaccatgcatggctaatttttgtattcttagtagagacgagtttcgccatgttggccaggtctcgaactcctgacctgaagtgatctacccacctcggcctcccaaaatgttgggattataggtgtgagccatcgcacccggacttttaagtagtaatagctatccatgaagaattttctttttaagagactacatggttttttttttgagatggagtctcactctgtcacccaggctggagtgcagtggcgccatcttggctcactgcaaactccgcctcctgggttcaagtgattctcctgcctcagcctcctgagtagctgggattacagggcttgctaccatgcctggctaatttttgcatttttaatagtaacggggtttcaccatgttggtcaggctggtcttgaactcctgacctcgtgatccacgcacctcggcctcccaaaatgctgggattacaggtgtgagccaccgtaccctgctgagactacgtgttttttaataaatcaaagaaataaaatacctatcctatttattttagaaaaacattacttctactttctgcaatacaagctggtgaaaataaaacaaacataaaaaacctcacagtctcccaatgttttcagattttggcatcctagaaagaaaacttgcaatgtcagaacaattatcatattggaaataatttaaaatgtccagcaacagcgatggttatataaaataaaatccattcacacagtgcaaccccacacagcagcttaagtgagattgatctctgtctgcaaacataaaaagatctcaagacacactgttaagggaaaaaaacaaaatgcagaatacctgtgtttacaatgtgtaaaaaagagtgctaaatgcatatatgcacacttctctatgacatatatgtccataatacataggataagatgtggaggggtatggaaccaactaagaagacagacggactgaaagggaaaagaggctttagggaacttaataccttttttactttttctgtactgttggaatattttacaaaaatgcagtaaagctgcttgtgaccatacaaatattcaggctacagttttatctcacactagtattaggttttggaaaaggcttctacacccaatcacttaaaattatattttaaagaatccttaaaaacaatgagttctgaagcctaaaaaaattccctgaatgagataatagaggatgaggacactagcagtagaacactgagaatgactgattataagcaaatgattttctctcaggtaaatttacatcccctatatagtataaatatatcaaatggactctgatatgtggctgatgtgatttggacatttttgagaaaactgaacagttttaaggttcttgatctaaaaacaatctcactgacccactgaatatactctcaggaaatttttaagaagaaaataataactaaaaatatatacaaatatatataataaaatagtcaatgcaggtttacttatattagcaaaaagacagaaaaattaaaaccaccagcaagagaaaagtagtttttaaaaatggtagaacattatatactcattaaaaatcatatttacaaccaataaataaagaagacaataaagaaacaaaccatttgcttatccctcctactaaaccccactgaaatagcaattaatacagtaaaaaaggattgagaaaacaatcacacaaatctagactattggaaattccataaggtaagctgacctgagctcttcaaacgtcatgaaagaaaaaaaatgaagtctatttttatattaaaaagaaaaaagagtcttcaatgcagtatgtgatccttaattaaatattcaatgtgatccttaattaaatactcaatgcgggccaggcatggtgagccaagattgtgccactgcactccagcctgggtgacagagactccatctcaacaaaaaatcgaggcaggcgaatcacgaggtcagaagttcgaaaccagcctgccaacatggtgaaaccccatctccactaaaaatacaaaaaattagctggacatagtggcaggcacctgtaatcccagctacttgggaggctgaggcaggagaaatcgcttgaacctggctggcagaggttgcagtgagccaagaccacaccactgcactcaagcctaggccacagagtgagactccatctcaaaaaagaaaaatttcaaaaaaagaaaaaaaaaaacctgataggccaggcacagtggctcacacctgtaaccccagcactctgggaggccaaagcaggtggatcacttgagctcaggagttcgagaccagcctgggcaacatggcaagactttgacactacagaaaatacaaaaattagtcaggtgtggtggcacacgactataatctcagctacttgaagggctgagcagggaggatcacttgagcctgggaggtggcagttgcaataagccatattagcaccactgcactccagcatggacaacaaagtgagaacctgtcttgaaaaaaaaaaaaaaagtgaaaataaaagtaaaataaaatctgggccgggcgtggtggctcacacctgtaatcccagcactttgggaggccaaggcgggcagatcacaaggtcaggagatcgagaccatcctggctaacatggtgaaaccgcgtatccactaaaaatacaaaaaattagcagggcgtggtggcaggcgcctgcagtcccagctattcaggaggctgaggcaggagaacgggcgtgaacctgggaggcggagcttgcagtgagccgagatcacgccactgcactccagcctggaagacagagcgagactcggtctcaaaaaaaaaaaaaaaaaaaaaaatctgataaatagcataacagagatccaaagtattttatccataatagaaaaacggaatattagtttgaaagaacaatgagaaaacaagaaaatgctctgagaaattataaatagtggctgaactaaaaattttttaaaagtcaaagaaagggctaaaagaaaaagttaaggaaatatcccacacacaaaaaaaggcagtaagtgaaaaggtaaacaagataaaggatcaatccagaaaggtcaacattcaaccaagagctccagaaagagaaaacagaaaattaatttctcgtggatttgttcagtttcacatatatgatcattaaagaacaaaattaacttcttgcagatttgtttagtttcacatacatgatcattaaaaacctagtttcacactaagagggcccaacaggtgtcctacacaatgacatctagacacattgccatgaaactacaaaataaaaaactaaagcaaacaggcatatctcaaagattctggaaagaaaaaacaggcagttaccccagaagaatgataatggaactaacaacagccttttcttcagcaatactaaaattttgaaaaaagtaatctttgctttcaaatttcctcagaaaaaatattttcaatacagaattcatgtaaagataattataaaaagaggtaattttcaagcccacaaagatttagtttttcttccacatagcctttaaaagaaagttataagatactccagcaaaacaaaattcttatcatactgtcctttgactatttacttgtctgtatcctcattatactctaaaacctttgttcactttcaatccttggcacctgacaccaagtaggcactcaataaaaaagtactggcatagactgtcctcaggaatgtggaagactaacatagaatcccacatagtaatgaatccctaaatctaacctctgctgtctcaggatcatgatctcacggtgagacctcttgtctgcaaactctacctgttttaaaagtttagcgttcctcagctactataatacaatcctcaaagatctctcttctgttaactcctatgacatttaccacttgattagtactattatattatttactgtttgatatatctaagcatagttcttcaaatgcatactccctgagggaagaaactttgacttacatgtaccaccagagcaagcagcacaatgttggacaatacacatatttgctataatgggcaaccaaagaatctcatcactggggtcaggattagaaactctactataactcaatctcaggcaattagaatatatcctaaaataattctctgcattgcaataatcaagaattaacattaggtcgggcatggtggctcacgcctgtaatcctagcactttgggaggccaaaacaggcagatcacctgaggtcaggagtttgagaccagcctgggcaacatagtgaaaccctgtctctactgaaaacatacaaaaaaaattagctgggtgtggtggtgggtaacctgtaatcccagttactcaggaggctgagggaggagaatcgcttcaacctgggaagcagaggttctagtgagccaagatcgtgccactgcactacagcctgggtgacagagggagactcagtctcaaaaaaacaaaaaaagagttaacattaatagtgttacagttcttttagaatttatctagcaggctttctgctttttgctgggaagcccataaaaaacaaacatacaaaaagagcattaatatcattacatattctagttgatacttactacctaccatacatctttcaacaagtattttttaagtacctactatgtgatgggcacatgtatttttataacacatacaaactatttaagaaactctcacataatcctagattaacatctaaaccactagttctcaaacttttttcttattaataaacacagtcttattcagaacttgagattcaaacagatcacagaactgctctggctggctaaggcttacataagataaggcccatagtccaatctgtcagtctatggaggctgccataataaaataccacacactgggtcacttaaaccagtggtccccaaactttctggcaccagggatcggtttcatggaagacaatttttccacagagaaggtggggaaaatgggttttgggatgaaactgttccatctcagatcatcaggcattagattctcaaacctagatccctcccatgtgcagttcaaaatagggttcacgctcctatgagaatctaatgctgccactgatctgacaggaggcagagctcaggcgataatgcttgctcactcaccactctcctcctgctgtgaggcccagttcctaacaggccacaaagcagtaccgttccatggcctgacccctgacttaaacaacagaaatttattttgcacacttttagaggctgggaagtccaaaattaaagtgcccacagattcagtttctggtgtgggctctcctcctggcttgtggactgccaccttctcactgtgtcctcacgtagcagagaaattgccagtgtctcttcttcgaatcagttctatcagatcagggctccactcttatgacttcctttaacttctatcacatccctaaaggtcctatctctaatacagtcacatcagttaggcttcaacatatgaatatgggggacataattcagtccatagcatcatttcctgaactttctctttgatacagatccaaggatatctggatgaaaagactaaaatcatttaattagataatttaattttacagaaaattggcaggcagggaagttaaatgacttgccataagtcacattaacagtcagtcacagaatttaagattagaaccccagtccctcatctcttccattctactcaactttctctcatcacaccatgaacagtagtgaagtcatcaagtactcttgtgacatgaatgttgaaggagccacatgagacatcattaatcatgaaacctcccacatgaactccaaactcatataaccaatgcctactcaatactataggtgggtgtctaatacacatcatcaacttaacatgtccaaaatcaaactcctaattttcttctccaatacctcctttagctcccaatttttccagatgcttgagccaaaatactatggagtcatccttgactcctcacatcttttattcagtgcatccgcatatcttgtgttagctctcctttcaaaacatatccaaatttctataattaaaggttaaaaaaaatttacaatctagctaactacttttctccacctctaatatcaccatcatgatccaaattgccaatatctctccatttgaattattacaagaacatttaactccatgcttctgtctttgacccctagaacctactctcaaaaaccaatttgagatcatgtcacttccataccagaacagctctccaacagcttcccaactcatacttactaaaacccaaaggtcttataatttcctcatgattaggattacaattacctctctgatgtcatctttaaaccacactcccactctcacattccactccagccacactgtcctcctttctgttccctgtgcatgtctgccctcctcaccattcttaaaaaggccacctttattaacaaggctttccctgaccatcctaattaaaatggcatattcccccattgctttatttttctccttttttatttccttgctttatttttctctttcacttaccatcatctgacatactacgtacttgtttaatgttcgtctatccctagctccatgaggaaagagatttgtttgttgtggtactgtatcctcagcacctagaagaggatttggcgaatattaaacgctcgataaatatttgatgactgaatgagtgaatgcatgaatgaacaaagtcataaaactgggcttcaaaagctcatcttgtctagcatcataactagaaagtcataaaaaaaaaaaagttttttccctttctgacagaatagtacagtgagtcgaagccaaaatatcagggattcatgtagttatgggccaaaatgcaacaaggaaagagaatgacatatacatagcccttaagtcactcagagacttatgattgtagttttcagccacataatcctttccatctgaaaattcccaaatatttagtaaagagtgtgtgtgtgtgtgtgtgtgtgtgtgtgtgtgtgtgtgtgtgatggcactgtcctcacatgaaaacaaacaaaattaactaaaagcccatttacatttacgtatagaaatgcatagtccgccgggcacggtggctcacacctgtaatcccagaacttcaggaggccgaagcaggctgatcacctgaggtcaggagttcaagaccagcctggccaacatggtgaaaccccatctctactaaaaatacaaaaattagccaggcatggtggtgggcgcctgtaatcccagctattcgggaggctgacgcacgagaatctcttgaatctgggaggtggaggttgcagtgagctgagatcatgccactgcactccagcctgggcaacagtgcaagactctgtccaaaaaaaaaaaaaaaaaaaaaaaggcaggcaggcatagtaataatataggaaagcaggccaggcacagtggctcacgcctataatctcagcattttgggaggccaaggcaggaggactgcttgaggccaggagttcaagaacagcctgagcaagacagcgagaccccttctctataaaaaaacaaacaaaaatagctgggtgtggaggcatgcacccatagtcccaactactcagtaggctgaggcaggagaattgcttgagaatttgaagctgcagtgagctatgatcatgccactgccctccggcctggccaacagagtgagatagtatctcctaacaaaaacaaacaaacaaacaaaaaaatacaggagagctttaaacaaaactttgtgagagaaaatgggactactgaagggaagtagtcacttttactctatatatttgtgttatctattccttaggcaacaacagtttgttcaattttatttagacaatataaaaattaacaaaataaagctcttcaacctccttcctcagagatgaccactaataacagtttgttgtgtaccattacagatcttctgcttgcgtaatcaaatggatacacgcaaataacttttaaaaaataagtaaaatgacaagaattctgcttccaaaaaaatggagtagacatacttgtccctattcctcctgccaagaacaactaaaaactcttatgttacatataaaataaacctcagaagaccccaaaaggtaaaggaaaaaatacatagactggctagagacctcaggaccaagaaaacaacatggtaatgaattctctggattttcattttgcctcttataacccacacttggagggtggaaatgaagaagtcagtaatccagaaacaccacaggcacaaacaaaaatccccaacaaaagcctgctctttttaaccaaaggaccaggaagggcacagccgtgcaacacagaaaacttttagacaataattactctactccaaccaaacactacagaaaaaaactgtggccccacccatgtctgcaaagaacttgattttccaactccctcaacccctccaacaggttcatgtcagagaaggccatatagagaacaggactttcatactagccaggtgataataaaccaccaccagcaccccaatgcaccctgcggtctcagtggagaccatgtggggagagtaaaaggtactcctattccttctagatagagaggcttcagtagcagcctagtgaggagccagaactcccaccccagcttagcaattaagaggaacatccttcaagtgtcaatggaggctaaatggggaacctgcacttgtaccccctgtacttcatgccatatggggactcatacttgcaccctcatattgcattaaggcagcacactctccctttgagaaacagccaaaataaaaaggtcaaataagatcaccagtcacacaacataatactaaaaacatccaagtttcaataaaaaatcactcatcacgtccagaaccaggaaaacctcaaaatgaacgaaaaggacaaccaatagaagccaatacccagataacaaagatatcagaattatatgatgaaggctgggcacagtggctcatgcttgtaatcccagcactttgggaggctgaggcaggtggatcacctgaggtcaggagttcaagactggcctggccaaaatgggagaaaccccgtctctactaaaaatacaaaaattagccgggcatggtggtaaacgcctgtaattccagctacttgggagggtgaggcatgagaactgcttgaacccaggaggtggaagttgcagtgagccaagatcatgccactgtactccagcctgggtgacagagcaagaccttgtctcaaaaaaaaaaaaaaaaaaaaaaaaagaattatatgacaaagcagccatcataaaaatgcttcaaagaagtcaggcccagtagcatgcacctatagttccagctacttaggaagccaagacaggaggatcacttgagcccaagtgttggaggccggcctggacaacacagtgagacccatctcttaaaatggttcaaataagcaacaatgagcatacctaaaagaaattaaaaaaaaaaaaaaaggctccccaaagaaacagaatatataaagaaccaccaaataataattttatttatttttattttttgagatggagtcttgctctaccgcccaggatggagtgcagtggtgtgatctcggctcattgcaacctccgcctcctgggttcaagtgattctcctgcctcagcttcccaagtagctggaattataggcacgtaccaccatggaaggcttatttttgatttttaatagagatggggtttcaccatgttggccaggctggtctcaaactcctgacctcaagtgatctacctacctcagcctcccaaaatgctgggattacaggcgtgagccactgcgcctggccccaaataataattttagactgcaaatagaataaccaaaataaataagttaaacaagcttacacaatgcattcttgcttcttacactcaatacataatgaaaatccaagtctctctgtagacacatatacagcattttttagtagctataatattccactgtaggaattaactatcatttttttaactaatcctcaattaatgggcatttatattatttataatttttcactattatacatcctgcatatgggcataattatctaggtcatttttaattatgtccctaaaagtgacagtgctatatgaaagggtacgcacagattattttggctttttttgaaacagggcctcatactgttgcccaggctagagtacagtggcataattatagctcactgtagcctcaaactcctaggctcaagcaattctcctgcctcagcctcttgagcagctgggactgcaggcacacaccaccacacctggctaatttctttttattagatggggtctacgttgcccaggctggtctcaaactgctagactcaagtgatccccccaccttagcctcccaaagcactaggattacaagcatgagccaccattctcagcaggggcatgtacgttttaaagtttaacacacactgccaaataaccctccaaaagagttgcaccaatctatattaccactaatagtgtatgagtatacctactttttcacattcttgccaacaacaggtattgtgtaaacgtttttccttgttttctactttaacagatgacaacagtacttcattgttatttgtgcatatatttctatttttttagacagggttttgctctgtcacccaggctggagtgcaatggtatgatctcagctcacggcagccttgacctcctgggctcaagcaagcctcccacctcagcctcctaagtagctggaactacaggcgcttgccaccacatccagctaattttttgttgttgtattttgcttgtagagatggggtttcattcgcatgccttgggctcccaaagtgttgggattataggcatgagccaacatgcccagccttttacatacatttattattgatatgttaaatatattttcatgtgtttaaaagtcaaaacatagccaggcgcagtagttcacacttgtaatcccagcactttgggaggccaaggcgggcagatcacttcaggtcaggagttcgagaccagcctggccaacatggcaaaaccccatctctgcttaaaatacaaaaattagccgggcatggtggcgtatgcctgtagtcccagctgcctgggaggctgaggcaggagaatcgcttgaacccaagaggtggaggttgcaatgagccaagatcacaccactgcactccagcctgggcgacagagcaaggcttcatctcaaaaaaaaaaaaaaaagtctttcttttaaaaattaccaactgagaacttctgtgaattctcactgtttatcttactaatatgagtcttcagtatgttagaaatattatcagccaggtgtagtggctcatgcctataccacataatcccagcactttgtgacctgtggttggaggatcacttgagctcaggagttcgagaccagtctgcctggggaacacagcgagacctcaactctaataaaaattttaaaaatgagccaggcatagtggtgtgcgcctgtagtcccagctactcagcagtctgaggtaggaggatcacttgagcctgggagattgaggcggtagtgagttatgatcgtgccactgcactccagcctcagaggaagactctgtcaaaggaaaggaaagggaatggaaaggcaaagtcaaagggaaagggaaaggaaggctaaaattctccctgtcttcccttttgaaaaaaaaattaaagtaaaaaaggaaaagaaatattacccatttatgcaaacatattttctcccattttgctgttttcactttgcttatgccgttttttggcagaagtagaatttttagttggtttaacttccattttaaaatttaactagatctttgctccatttaagttgaaatactaaagacataaacctaaaggctcagtccgaattagttttagagccaaacaatcataaaatcaccactccacggccgggcacggtggctcacgcctgtaatcccagcactttgggaggccgaggcaggtggatcacaaggtcaagagattgagaccatcatggctaagacggtgaaatcccatctctaaaaaattagcagggtgcggtggcgggcgcctgtagtcccagctactcaggaggctgatgcaggagaatggcgtgaactcgggaggcggagcttgcggtgagccgagatcacgccactgcactccagcctgggagacagagcgagactccgtctcaaaaaaaaaaaaaaaaaaaaaatcaccactccactactgacaatagtgtagaattagtcatgattctaattagagaaaagaaaagaatgcaggtacccactcgttacctatacattcaattaacaagtctactctccaaaccacatatagatggagtatctgttatatgaaatccttgcgaccagaagtgtttcggatttttttttttttttcagattttggaaagatacaaactggtttagcatgccaaatctaaaaatccaaaatccaaaatgttccaatgaacactcctcctttgaatgtcatgttggtgtgcaaaaatttcagattttagagcatttcgggttttcatattaggaataatcaatcagtaggtacacagttcccccaggtggtatgactggactttggacttgatttttaaaataatattccatttccccattgggatcccactcctactctaagccccaactacctagctggttacctgacagctgttttttcttctggagaatggaccctttcccacggcttcactgttatctggaaacctaactcaaaataatcaaaactctgaaaactactagtctgttacctgatggctcattatcatcactacttaagagatctgttaccatgctcccccccgtttttggatattgacctaaatttactaagttaccttgggcattgtaatttttactgctagtcaaattacttgagcagaagctcacaacggatagtaaataaagcaaatgtaatgtattattcctttattttactgggaatctgttcttcctacttacttatcttcccccaccagccatttacagcttttggcatacttcatggtataatgctgctggtttatgacaagtaacattaacaatgtcatatatataagcacaatcactagaattctaacttctgtgaatgtcacatacataaagccataatgaaagacagtttaaaaagataccttttaataacatgaaggaaaaaaattcaaaataacatatctatacaaatacatcctattgttattccagtatttcacagaataaagaatttgtctatataatttccttcagtagcccacaaaatatttaccactcctttccttaattaccattgtattaaagacatctgatgtcaatgacaaaaactccagtattaatgcttaagagctaggttacattatttaagtttttcatttaatctaacatcttcaagtcatagggaactttttaaactaatcttgttcacactccaggacattcccacgccaaaaaaaaaaagtcagatcaacagccagaaaaaaaaaccaaacaacaaaaaaaaccacagctatatgctgaccacagcatgtagttagcaaagaccatacccttagctgaagaaatagagcacaattccttaaccttcaattccttaacaacctacaaactatattgtattggagccaattttatgaagtatcaaagtattaccattctggaccaggaaaaaatatctagaaaggacattattaggttctcaactacaggcagtttgccccccaccaggaaacacctatagttgtcacactagaggaaggagaaagaccacaagctgccggcatctagtagccagggatgctgctaaacatcctataaattacacgatagcccctgacaacaaagaattatctggctcataatgtccatagtgatgaggttgggaaacctgagacaaatgatgaaatgtgaaaatgaactgcactgtatcaatgttatatttcctgaatttagtaatttttctgtggcttcaaaaaacaatagccttgttcttaggaaatacacatcaaagtatttaggaataaaggaacatatctcaacttacaaatgactcagaaaaaaatatgtatacatgtagtggaaaagaatgaatgataaagtaatggggcaatatgcaataattgattaatctgagtagagtagatacagaaatttttttattattattgcagtttaaaattataccaaaattaaaagctaaacaagtattaccatgcccataaatttattttacctgggaaacttggcacaatttcccaatatatatgtgcaatatagcgaatcagctttcttttactcctttctcaaaataaattaccctatcttgaatggatacttgcaaattgaacccaaataactcatgtaagctgaaagtataatttctaaaatgtgaattgcacaaagttagaaatgcttagatgtctaccaaggacatgacatactattgtatatcacagtaaattcatggccaatatccctgcattgtatattttaggctttcaatacacacagaaagctgaaaccacataagatctgaacatgatcagtgcaaatggatatacaagaaataatacaaaaagatttttttaagactcagattttcataagtttaacattagttctgaattcttgaattttatcatttctatttctgggcaattgttactttaaacagcatgcaacaaattataataacagcttcataaataacaacagtttacttttggaaaacaattctttaaaattttaaatccaggaaaaaaaaatttagggaacttacagacgtttgggacatacttgactgctgtgtgacacttcctgtgggagatgtagatggtcttccactggacaaacttgcctaaaatagtaagacttttagaatatgtcggtaaaaacctgaagttaagaactttctggtaccatgataacacaaaaccacaacaataaatgtcaaaaggcctatgtatgaaacaactaattttatagtcaacatggcttaagcttcggttaaacagattttttaaataaggaaaagctgaatggtgaaaacaggggatccaaagactaatcttattttattagctactttattgtcagtttcactttatgggtctctgtcatctttaaagtggaatcactactccagagttatgaaaaagaaattagagctacagcaagagccagtgagtgggtttcagtttcctaacttgtatcacaaacatgttatttaaaaattacactactaagaagcaacagctgagaatctgttggtaacagaaataaacctttttcaggttcagtcaattgagatcctcctctggtgaggggatttaagattaaatcttacacagctttatttaaatagtacaatagtaacaaaaatcttttttaaaaacaagcatttaataatgaaatcctgttatcagtaggaataatatgattggattttagaaaaatggatatacctatctttgtataaaaaatttctggagaaatatgtattagattgttactgtggccacctttgaagaacgggaaacagtgatagacagggaaaaggaacagctttactttatctcttataaacaacttaatattgtttgattttttaatgagtataattacttatataatttttttaatcttatttttagtaaaaatacaatttatgtaagcctaagtactcactgttgtacctagaactttatacacataaactagcatagcatttcttcaatctggataaaaagcactgagacaaaagctagaaacagagtaacataaaaaaacatatcccctttttctcaattaacttctattcggcaacctattaatatatttcctccgggaaaaataaccacaggacatctgagaactctgaaataatacccaatctatttattttcagtaactacctacagataacagaaactttgatctcataaactcttattttagtcttacctgaacagcagcaaggctctgaagctgggagctgcttaaatgctgctgctgaagagctgcagtatgcagcatcaagtgctgttgttgggctgcatacatttgctgaaggtactgagcagctgagctggggggccgatgcaatgcctgttgaattacctgtgataagtcaattgaaccaatgtcaaaccataatctcaacctttatcttaatcagaaaatcaaagtataaaaaagtggcagtttaaaatttcactgctttaatacataatatcatcaagcttattaacattatttctttcctagttacatatcactagaaatcactaacttgtacacattaaaactacccagtgggccgggcacggtggctcacgcctgttaattccagcactttgggaggccgaggtgggcggatcacaaggtcaggagatcaagaccatcctggctaacatggtgaaaccccgtctctactaaaaacacaaaaaattagccaggcatggtggcacatgcctgtagccccagctactcgggaggctgaggcaggagaatcgcttgaacctgtgaggtgaaggctgcagttgagccaagatcatgccactgcactccagcctgggcgacacagcaagactcccatctcaaaaaaaaaaaaacaaaacaaaacccagtggacaattcgcaaaagacaggccaggccaactaagcatttcaaaagattttcaatctcaccagtagtcaaaaacttacaaattaaaacaagatactgttttccaactttcagatggataaagatttaaaagaatactactactacctggggaaaccaatactcccatattgctagtaaaaattcaagttggcataacctttttggataaaacttcgtagaattcagggcttgggtgtggagagaaatacctttaccatgcaaccataacaaatagtaatgtagatcagtgctgtcctatacagtaacaactagtcacatgtgcctactgagcacttaaaatgtggttagtgcaactaaagaattgagttaattttaaattgaattttaattaattttaattttaatgtaaacagccacaagtaactactggccactatagtgtacattgctgataccgatctatatttactaacaaaaagaaaatcagtgggttacaaaatagtatatagagtaagataccatttttatattaaaatatttgaaagaatccacaggaaaactttcaaagaccactgatgggtagctagattagaggtgatttttagcttctacttcatactcttctatagatgtctgaaaatcttacaatgagcaggtattattaataatcatataaaattacaaagcagctgggcaggttggctcatgcctgtgatcccaccactttgggaggccaaggcaggcaggtcacctgaggtcaggagttcaagactagcctggccaacatagtgaaaccctgtctctactaaaaatacaaaacttggccaggcatggtggcatgcacctgtaatcccagatactcaggaggctcaggtgggagaactgcttgaacccaggaggtggaggctgcagtgaccagagatcatgccactgcactccagcctagacgacagagcaagaccccatctcaaaaaaataataataataaaataaaaataaaaaataaaattataaagctatttcttctttagaaaattactcaataatttaaaaaatttttaaatgtcaaataccttgttttgcttcaacattgaataaaactattcttacttaattccttaaaaagtgttaattactgtgaatatttgttagtaaaatgtaaaatctgagcctgaaacttcataaataaatatagaaaagtcaagtactctactaaaatcagagaaaattcttacatttctccaaaaggttaagtcagaataagtcaatcctatacaaccaaatccgaaagtcacattgtgctcactgtgactctgaaacagcacagaaccctaatcgcagcatcaaaccagagttttcaaagagctaagggagtaatagtgccataatcctatagcttgagggtctctcaggacatcttgagccataatgccatgaatccttttatctaaacttcaagacagcatatttctgtgtgttattgtttattttcatgtgttaatatctcacctctccaactatagactactatgcctgatacaaatttctgtcacaaaatcaatgggagcttttgacctctacctgcaggggactataggccagcattaagtgattcagaattataacaatataccttttttagtcagatcaatctctatttgttcttctaattccataacaaaattctaaaagcactggactgtatacggaaaaaaattctaaaatcaaactgaaataacaatctatttgacacatacttttgtcagagtatactcattttttctgttgtcagcacagtctttcactactattcaattactcacagcaatgagtaaatacaagttatagatacagcaaattgttcttatttattataaattcttattcacccaaggagggtgaagagaattcccaggacagaaaaagcaagctggaagattaaagaattacttaggtagttcaataaatattgatttgatttcattttgggagaagcaattctatggtctcataagaaacagagtcagtgctatttatgagatatatctacatctacatatctttctattaattttttattaatctatgcagcttaattgaaaactagaggacaaaatggtatattaagcgatcacattatcagtcaggcgtggtggctcatcccagcactttgggaggctaaggcaggaggagagcttaaagccagaaggtcaagactagcctgggcgacatagtgagatcctgtctctacaaaataaaaaaattagccaagcatagtcacatgtgcctgtagtctcaactactcaggaggctgaagcaggaggagcacttgagcccagggggtcgtgagttgtgatcatgccactggactccagcctaggcaacacagagggagagaagaaaaaaaaaaaaaggggggggccaggcgcagtggctcacgcctataatcccagcactttgggaggccgaggcgggcggattaccagctcaagagattgagaccatcctggctaacatggtgaagccccatctctactaaaaatacaaaaaattagctgggtgtggtggcacgtgcctgtagtcccagctactcaggaggctgaggcaggagaatcgcttggaccagggaggcagaggttgcagtgagccaagatcgcgccactgcactccagcgtgggctacagggcaagactcagtctcaaaaaaaaaaaaaacaaaacccggccgggcacggtagctcatgcctgtgatcctagcactttgggaggccaaggcaggtggatcacaaggtcaggagtttgagaccggcctgaccaatatggtgaaaccccatctttactaaaaatacaaaaattagctggatctgctggcacatgcctgtagtcccagctgttctggaggctgaagcaggagaatcgcttgaacctgggaggcagaggttgcagtgagcctagatcacgccaccgcactccagcctgggcgatagagcgagactcggtctcaaaaaaaaaaaaaaaaaaaagatctaaatccttttccctgtatcccttacctcagagaaaggtaaaaaacattaaaacctcactctgcattcaagtttgaatttctggtgaactggctggttccactccacagtgattttggaaaactaaatcctaaaccaaaaacagttaaatagacattatactggggtatccaccatggaaaaatggagcagaggaaggactatattgcaagcagttgttttcagggtggatgcaattataaggattctaccagaagaaagcaggtataatagaaaaaataagaattcacagagtggttaagggcacaagggctgaagtctgagaactagctaggtgagtttgggaaagttatttagctgatttaaaacatttattttcccatcagtaaaatggagataataataatagctacttcacagagggctggtaatgattaatggagataattcatgtaacatttatcaaatgtttggcacgtagcaattattcaataagtattagctattactatctactggaaacctataatgtgccttacacagttctagatacttcattaatctcaaagatacttcatttaatcctcagagtaattaatgaaagaagtagtctcaccctcattttagttttctgaggctcaaggggattatgtctcatacccaaggctatatagctcctaaagataatgaaaatggaattcaaacaaagtataatagagtggaaggtccatgccctttttatataataccatattgccccaacctccattatcataaatgttaactaagtaaactttactttctcaactaagtgacttcctagttcaatattcccttccccctctgcccctaaggtatttagaatggatcctcctgcttagggttcttaggccacctgggtttaatataaacttcgtaacatatctacatacctgaacagatctccctaagtctatattttgagttccaatataaaataaagctacaaccattctgtatgttggggctctaggttgaatgccttcatactgtagcagcacctagagactttccccttataattttctttacacataatcctataaactacatgctgacaaatgtaagccctctcaatactatatatatatattttgagatggagtctcactctttttgcccaggctggagtgcagtggcgctatcttggctcactgcaacctctgccgccagggttcaagtgatactcctgcctcagcctcccaagtagctgggattacaggtatgcattaccatgcctggctaatttttgtattcttagtagagacggggtttcaccatgttgatcaggctggtctcaaacacctgacctcaagtgatccgccagccttggtctcccaaagcgctgggattagaagtgtgagccaccacgcccagcattttttttttttttttttttttgagacagggtctcactctgtcacctagactggagtacagtggtgcgatcacagctcattgcagccttgacctcctgggctcaagcaatcctcccacctcagcctcctgagtagctgggaccactggcacatgccaccatgccctgctgatttttgtattttttgtagagatggggtttcaacatgttgtcccagccagtctccaactcctaagctcaagctatctccctgccttggtctcccacagtgttgggattacaggcgtgagccaccacgcctagccaatagtatgattattaattaactttgttggctgttgctgtggttaaatgtgtcccccaattaagtatgtgttggaaacttaatctccaatgcaacagtgttaagaggtaggacccctgaagggtgattaggccataaggactccgcccacatgaatagactaaaggaaaatttttttttttttttttttttgagacggagtctcgttctgtcgctcaggcgggagtgctgtggcgcgatctccgctcactgcaagctccgccttccgggttcacgccattctcctgcctcagcctcccgagtagctgggactacaggcgcccgccactgcgcccggctaattttttgtatttttagtagagacggggtttcaccgtggtctcgatctcctgacctcgtgatccgcccgcctcggcctcccaaagtgctgggattacaggcgtgagccaccgcgcccggccgactaaaggaaattttaaaagggcttgaggctgcaaatttggtatcttgctctctagtcttccaccacggaatgaggcaataagacggccctcgtgagatgccagctccttcatattagacttcccagcttccagaaatgtaagaaataagtttcttttctttacaattacacagtcttggtattctgctatagccacacaaaatggattgagacagttgattgaaacattagtaattctaactgtacatttgagaatatgaaacaatacataaatccagcttaagcaaaaagtaatatgacatcttaagtcttagactacccatcactacagctgaaatacctgtacagcatgtcggtctgaaccactgtagacagagatctgtggctgctgcattcgagaggaggaagtggtgatggtggtggtggtggtactgctggttgttgttgacacagaagatgttcccgggtttggttcagtatccatagctgtactatggtccttaaatctggcaggtcacacaaagtgtttgtattggtaaaagcattatcttatgagctttaaagaatattcattccaaagaaataatcagcagtaatctaaactgctaggaaggctctcataaaagacagccaacacacagtcactataagcacttagaagggaaaaatacttcacatatatggagcatatttaatagttaatacctactacatttgaattcaaatgattcagaatacgtaactcagataacgcatagccaaaagtttatctttgcattaccgaaagattttttttaaaccaaaacaggtaatgagagaatactaaactacctaggaaaataaaaatttaagcagtatcagagtattttaaaacatttctttacattcttttgaccacactaattacaaactaaagtcattcttacctatacattagaacagaatgcctagggactcatgttaactagcttagtttagtttaccatataaactttgcttaaaaataagttctttttaaaaaatgttaaaaagtaatttttttaactcacactggcttttcccctaatcagtctacaacgctgtccttactacttctaatagctgagttatacttattagcagattgctgtgagaacacagagaagcagcaaacagcaacttcccatacccttacaaaatctttttcacaaagaattactccagattttgaaaacataaattatgtcacttcctcatgtatggacagtaaagtacacttttataccagactttcttccctccaatactataatcttacttgttgtggtacaaaattccactaaatacagaatctgtatttgaataaattcaaacactttaagtcaattctaaggacctccatattgttagaaaccagaagagcagtagtttttgtcgggccagaaatgtacctcgaaggtgaaaagcacacaagagattatactggttttatctcccttttcttatcggtcttttcttctgagaaactaaatcccacccaccccacattagcagcactgataaaaatgtaagaacactttctattccatgaaaaaacaaatgaatctggcactaattggtacacatacactattaccatagcgttgcttttttaagtacaaattttctttgttctatattacgtatgtaaacagtatttatattctctgaggaaccaaatgtaaaaaaaaaccgaacaaaaaaaaaaaaaaaggaaaagtgggggccttgagtggcggttcacacctgtcatcctaccactcagggggaggactgcttgagcttaggcgttcaaagccagcctgggcaacatagggaaaccctgtctctacaaatgaaaaataaaaaattagccaggcctggtggcacaggactgtggtcccagcaacttgagaggctaaggtggggaaatcgcttgagcccaagagggccaggctgcagtgagctatgatcgtgccactgcactccagcctgggagataagagtgagagacgctgtcacaaagaaagaaaaagaaaataagaggaaaagtgaaaggaaaaccgtcaggaagaaagctgactcctcacttactttttggattagtaaataattcatacatttttatgcttctgttttttttttttttttccaaactgccttccaatcaaatcacagcatcatatggtaactgttcaacattatacagtattagtggtaggtaaggtaaactttttaccgaactgctgcctgtcatactactaccgtatcgtgtaccagtgacatgcaaaaggccagcttaagttctggttttttaaaagtgttaatctgctcaactatgccctccaatccaaacagtatggtaaacagttctaactcctaaccaaaaatggtcacagagaatccaaattctcggcataagtctaaacatcggttgagcggaactggccaaaccatcgcactgcatttcgaggcctggcacaaaagaacaactttggtaactccaccgtctaggcatactaatacctgcaaaatacagccagcagttctggtgcacaagaggcctacccaggaaacagtaagttctggagtcgttaactaaacataccgtcacaccgacacacaagaatgtggcccgcgtgtgaggcagcaacgctgcacccagagaatcgagggaaagacctttctttcagggtgttttcagcctcaccagacctgcaagcagcccccgccgctctcaggcccacgccgggatgcctccggcacgagggaagcgggcagccccgcgtgtcggattctcccgctgaggaggagtggggtggcgccggggcgggaaggagaagaaggcgaaggaggcctggcagtgcccgccctgccctacccagcctccgcgggcccctgcgcaggcagccgtaacaaggctgcccgcggggcccacttgcaggaatgacagcgcctgaggagcccacccgggctcgttccccggaaaaccccagctcccggagtcccaagggtgaccctgcgcgcagggccgcgcagatccgggacctgatggcggaaggggcgctcctgcctggagggtaactggaccctagagttcgtcttcgccccgcgacacgggcctagccggctcctccacgataggacgggtctcgagtctctctttccccacactgcccgcaaaagagccctgagctttcccctgggggaacgtgtcgctgccccaactcgccccccctagttacgacatcagtcaccatctagtcactcactccgcttccgccatcttctctcctccatcactaacatgggctgcgcatgcgccccccggcggcgggcggagaggcggggtcggctcagcccccggagccagaggtcacgtggcgtcctcagcttccaatcgcccccgcccaccataggaattgctctttctggaaagtgaccagatttcccccactaagataaccagtgtctcctctccaaacccctctctttctctcctccaggatcttcctcttggggagatatctgtaataaagatataaaaagttatcttagattgttaaatttaaaatttaaagaatatgggcgcggtggctcacctgtaatcccagcactctgggaggttgaggaggatctcttgaagcgaggagttcaggaccagccttgacaataaagtgagaccctgactctaccaaaaaaaagcccaacaataataataataataataataattttgaagaatatctaaaatataccaaagcctatgcaaactgcagagtggtttcaaagaaaatacccacgaggattagaggctgaggtctcagggagaaaggaaattcagggctggctgcagggcttgttgcctgggagctttggggcttgagggtcccaaccagcagtacctctctccagctgaaagatagtgttcagatgccagtgaatgagtggttaaggaatcatcctgactaccctaggcatatcattcatgtcttcagtatgaatttgctgagcgcttagtaggaattgcaaacttgaacaccacaaggaacaagcaggaacagccaccagtttgctagtgtagtctgctaaatgccaacaactcaggtgtgtgagacaaacatataaagataagtaaaataacacatttaaatataaatatgaaataataaagatgagtccttgtcttccaagaagtagcggagcgggttttatagacatttgcatacaatataatgtgttctgaagaccgggacgatggctcaccctcataataccagcactttgggaagtgaagttgggaggattgcttgagcccgggagtttgagaccaccctgggcaacatggggaaatcccatctctacaaaaaatacaaaaattatccggatgtcgtggcgcgcacctgtcatcccagctactcaggaggctgaggaaaaagtgttctgaaacagatctattaagtgctttggaaagtttaaagttcaaggtgtataataaatctttacctccctttacaggaaaaaaaaagcatacgaaccataaacaatgtctctttttgcattttgtgaggtgatggagtcacaataatttcaagaactgagaatgaagtattgatataaatccatccggaagtgtaatatggtctgatgaaaagtatacttagtcttagaaatcctatatgccaggatgtgcctaaggaagggaaaagaacacttcccatctatgtgagcttaaattgtccctttgcccacttttcccatctgataacatcttttttttttaccttgtctacctaatagcagtactatctactactacttctagaattcattgagaaagtctccttttaaaagtccctgtagaccaggcacagaggctcactcctgttataccagcaatttggggggccgaggaaggcggataacctgaggtcaggagttcaagaccagcctggccaacatggtgaaaccctgtctctactaaaaatacaagaattagccgggtgtagtggcacctgcctataatcccagctactccagaggctgaggcaggagaatcgcctgaacctgggagatggaggttgcagggagacagtgccacttcattacagcctgggaaagagactgagactccatctcaaaagaaaataaaaagtccttgtagatgctttaaaatattactgctttttctttcattctgacttgctcatatatcattgttattaaactttttttttttaaattgagacggagtattactctgtcgcccgggttggagtgcaatgatgagatctcggctcaccacaacctccgcctcccggattcaagcgattctcctgcctcggccttccgagtagctgggattacgggcacgtgccaccacacccagcaaactttttctatatttttggtagagacggggtttcaccatgttggccaggctggtcttgcactcctgacatcaggtgatccactggcctcagcctctcaaagtgctaggattacaggcgtgagccattgcacccggccttttattaaacttccaagaatcggccgggcgcggtggctcatgcctgtaatcccagcactttgggaggccaaggcgggtggatcaccaaacgtcaggagttcaagaccagcctggccaatatggtgaaaccccatctctacaaaaaatacaaaaattagccgggcggtagtggcgtgtgcctgtaatcccagctactccggaggctgaggcacgatgattgcttgaacccaggagatggaggttgtggtgagcggggatggtgccactgccctccagcctgccaataaagcgagactccgtctaaaaaaaaaaaaaaaaaacacaaaactttcaagaatcaactatacattggtattgctgaaactattttgtttagagaaacaaaagtgaagaaagcacagtcttaggcctaaacatggaaaatgcataaatcaaagatgtatttggaatacataggccaaaattgttctttttttatcctcctttcacttgaacatctaggtcctatatccctagtgttacctcgtacagattgcctttaaaaatgagaatatatgtccggtcacggtggctcatgcctgtaatcccagcactttgggaggccaagatgggcggatcgcctgaggtcaggagttcgagaccagcctggccagcatggtaaaacccggtctctactaaaactacaaaaattagctgggcatggtggcaggcgcctgtaatcccagctactcggggaggctgaggcaggataatcactcgaacccaggaggcagaggttgcagtgagctgagatcacgccattgcactccagcctgggcaacagagcgagactccatctaaaaaaaaaaagccaggggggaatatatgttgggtaaaatcagaatagtattgttttttagaaacatttcaatgctcaatacttattataacagctaacacttgtatcaccttttataaagtgcaaaggatttccataaaactcatttgttgatcttcacaataactctgtgatacagttatcatgattcccatttagcacggaagtatagtgagcttcaaggtaattaagtgcctcgggtgactgctagcatgtacaagaaatggagttctaatttaaggttgccatctccaaagccaagttttcttcactacatcattcagcaagccactatgcaaaacattaaaggggacaaggtatgatgaaagaccactctcaagaaacttaccggccaggcacggtgactcacgcctgtcatcccaacactttgggaggcagaggcaggtggatcacctgaggtcaggagttttaagaccggcctggccaacatggtgaaaccccgtctctacaaaaatacaaaaattagccgggcacaatggtgggtgcctgtaatcccagctactcaggaggctgaggcaggagaatcacttgaacctgggaggcagaggttgcagtgagccgagatcgcgccattgcactctagcctgggtgaccgagcaaaactccgtctcaaaaaaaaaaagaaacttacggtcaattgtctgatcaaacagaaggtattttacctctatcatttcctaggggaaaaaaatgtatatggtatgctagcaggatggattttctcaagttttgcaagaaccatgaccttggaaaagtacaaagatcctgttttattttagaaaaatccctctagctttgtgaaggatggactgggggaaagtgtaactggggagaggatcagttgggaaactgtgcattaatccttatagaaatgataagggtgggccaggcgcggtggctcacgcctgtaatcccagcactttgggaggccgaggcaggcggatcatgaggtcaggagattgagaccatcctggctaacatggtgaaaccccgtctctactaaaaatacaaaaaattagccgggcgtggtggcgggcgcctgtagtcccagctactcgggaggctgaggcaggagaatggcgtgaacccgggaggcagaggttgcagtgagctgagatcgcaccactgcactccagcctgggcaacagagcaagactccgtctgaaaaaaaaaaaaaagaaatgataaaggttaggggaagaaaagggagggctaaattgaacttttagttccttagtggcacagtcacatttcaggtgctcaataggcacacacggctagtggctaccatattggacagtacagatgtagaacatttccatcatcacaaatagttctactggacagcactggtctggtctcttgatcagaggttgccaaacaacagcccacagactaaatctagactgtaacttgtttttgtatggcctgcaagctaagaatggatttttacattttctaataattgaaaaaaaatcaaaagaatcatatgttgtgatatgtgaaatttaggtatttcagtgtccataaataaaatattattagaacacagccacactaatttctttatgtattatctgtggctgcttttatgctacaagggcagagttgaatagctgtgacagacaccatgattgtccgcaaagtgtaacatatttactatccagcatttttttttttttttttgagacagagtcttgctccgtcgcccaggctggagtgcagtggcgcgatctcggctcactgcatgctccgcctctagggttcacaccattctcccgcctcagcctccccagtagctgggactacagatgcctgccaccatgcctggctaatttttctgtatttttagtagagacggggtttcaccgtgttagccagaatggtctcgatctcccgacactgtgatccacccgcctcggcctcccaaagtgctgggattacaggcgtgaaccaccgtgccaggccttttttttttttttttttttttgagaccaagtctcactctgttgcccaggctggagtgcagtggcacgatctcagctcaccgcaacctccgcctgctgggttcaagcgattctcctgcctcagcttcccaagtagctgggactacaggtgtgagccaccacacctggctaacttttgtatcttttgtagagatggggcttcaccatgttggccaggctggtcttgaactcaaactcctgacctcaggtgatctgcataccttggcctcccaaagtgctaagattacaggcataagccaccgcatgtggctctatccagccttttacagaaaaagtttgctgactattctacatcattgaccaccctacactgggttctttcagagtacttaatagagcacacatactgtcgatgcctcagttggaccacgattgctctcataggatctaatgtgatgagacaaaaagtccaacagacttagattttaacgctgagctcactcctttaccaaatgagccacgttgagcaagtaatttaattgcttcaagtttcttggggtttttctgttttttgtggttttttgtttttttttttttgagacagagtctcactctgttgcttaggctagagtggtgtcacaatctcagcttactgcaacttctgcctcctggggtcaagcaattctcctgtctcagccccccgagtaagctgggactacaggtgcctgccaccatgcccagctaatttttgtatttttagtagagatggggtttcaccttgtcagtcagtctggtctcgaactcctgacctcaggtgatccatccaccttggcctcccaaagtactgggattacaggcgtgagccaccatgcccagcccaagttttattttataatgtaaagaaaaaaggggatgataatacctcacaagattgttgtaaagtctaaaaaagtctaatgtaaagtcttaaaaagtcctctttttctttttttcatttaattttttttagagacaatcttgctatgctgcccaggctggctggagtgcagtggcttctcacaggtatgaacatagctcattgtagccttgaattcctggggctcaagtgatcttcctgcttcagcctcctgaacagctggaactacaggcactgaccaccatgcaccttttttttttttaactttttatcgaggtcctctttcatctagattttctcaataactatgattgaatatgcataataatcagttttaaatgcttgttgagagaatgaagacttgaatgtttggttgaataagacaaaatttcagtatagcctgtaaatttgaatggcatatagatagacttgctttctctttaatactctaaaatcaaatactttttttggggggggacagattctcactctgtcacccaggctagagtgcagtggccgaatctggatctcggccttggctcactgcaagctccacctcccaggttcaagcaattcttgtgcctcagcctcccgagtagctgggattacaggtgcatgctaccacacctggctatttttttgtatttgtagtagagatggggtttcaccatattggccatgctggtctcaaactcctgacctcaagccgtctacctgcctcagcctcccacaatgctggaattgcaggcgtgagccaccacgcccgactccaaatacttttactaaaccaattttttttcctttttctttcttttttttttttttttttgagacagagtgtcgctctgtcacacaggctggagtgcagcgatgtgatcttggctcactgaaacctctgcctcccggattcaggcaattcttgtgcctcagcctcccgagtagctagggttacaggctcacaccaccacacctggctaattttttgtgctttcagtagagatagggtttcactatgttggccaggctgatcttgagctcctgacctcaggtgatctgcctgcctgcctcagcctcccaaagtgctgggattacaggcatgagccactgcacctggccataaagcaaattttattgaaactgaaaacatattccctagccttgctacctctcacctacttttgcaatagatcattatgttaatcatatgcttggcgaggcgcagtggctcactcctgtaattcccagcagtttgggaggccgacatgggcagattacctgaggtcaggagttcgagaccagccttgccaacatggtgaaaccctgtctctactaaaaatacaaaaaattagccgggcgtggtgatgcgtgcctgtaatctcatctactaggattactagggaggctgaggcagaagaatcacttgaacctggggggcagaggttgcagtgagccgagatcggtccattgcactccagcttgggcaacaagtgcaaaactgtctcaaaaaaaaaaaaaaatcacatgcttaccagtcttactttcccttatataccagtgggtggcactgtacacagttggctgtatctccctcggtgctgaagagtggaaacagagcattaaagttggaagggactttcgaattgatgtgacccatactgaggaagaattcatggcaaaagcagaatctaaactctgacctcccatcctcccattccagaattttttgcttagtgccacaaggcctcactacaagtgtgcagatgctcaataaacacttgaggatgctgtacactctcatttccattctgcttttatgcttagtttctgcttagcattgtggcagcttagaagcactgttgtaaagcagggctttcgaatcagacaaactaagacttgaatcctggctctaccatgcaccagctctgtgacctcttacaatcctatcagctccatcttcaaagtataaccgcatctctggccacaccactgtgaacatgcatgaattcctcaaaacacgtatcaaatctgacatttcttgtcacctccaccattatcagcctaagtcaagacacagattttttcctggaccacagcaataggcttctgacaggtcacctggcctctgttcttgttcctctacagtctattctgcatacagtaccttaaggaagaaatgtaaaccagagtgtcactgttctctcaaatcccccagtggcttcctgtcccaccaatatggccctgagtgattttcccttgctctgttggctgcagcctcactggcctccttatttccccccttagcacttgctacttccccagccagggatgcctttcacactgacctcacttccttattccatccagacctctgttcagacatctcctcagagagcgctccttgaccacccaacctaatatggccctctcatcacttttcttcccttatcccactaacttttcttcatagcacttcaatgcaacagacattatgtacatacttacttgtttatttatttactattcccaccaacctccaggttgtaagctccacattttgctcactgtgatattcctagttcttaaaacattaagcgctcaaaaattatgcattgaatgaatgaaactccttaacctctctaatccccactttgctaatctaaaaaatgagaataatatttaccacaaagttattgtgaaattaaacaaaaaatgaaataatgtatataaatagaacattaaaaatgctcaataagtgtagctgttattgttcactttttgttgttttgccacatattattatgctaaactaaagcaaaataatccttctatcctatttccaaaggacatattctttaattatgaggcaatccctagttttgaaagttagcattatacatttctttaatttgcatatgctatattttaaaatattgggcttctgtaactgagaatagatttttgcttgtatacttctaatgtattaaaataaaaattttggccaggcacagtggctcatgcctgtaatcccagcactttggcaggtcgaggcgggtggatcacgagatcaggagttcgagaccagtctggccaacagagtgaaaccccatctctactaaaaatacaaaaaattagccgggtgtggtggtgtgcgcctgtaatcccagctactcaggaggctgaggcaggagaatcgcgtgaacccgggaggcaaaggttgcagtgagccaagatcatgccattgcactccagccggatgacagtgcgagattctgtctcaaaaataaataagtaaaataaaaatttttggccaggtgaggtggctcacagtagtcccagctactcagaaggctgaggtgggaggatcattcaaacccagaaattcaaggttgtagggagccatgatcgtgccattgcactcaagcccggacgaaagagcaagaccctactatctcaaaaataagtaaataaatattaaaaatataaagctttatatcagtgtcatgtcaaatctttttttttgttaactcggttttttggcctccaaaagtgctggcattacaaacatgagcccctacacccagcccagaataagcattctaaagacctcttattgttgtaattgtagaattattcaagggcctcagcagaaaccttacaagccagaagggattgggatcctatcttcagcctccttaaactgagtaacagtcagccaagaattattattattattattattattttagacagagtctcgctctgtcgcccaggctggagtacagtggcacgatctcggctcactgcaacctctgcctcctgggttcatgtgattatcttgcctcagcctcaaaagtagctgggattacaggcatgcaccaccatgccctgctaattttgtatttttagtagaggcgggatttcactatgttgaccagactggtctcgaactcctgacctcatgatccacccacctcagcctcccaaagtgttgggattacaggcgtgagccaccacgcccagcaagaatttttttttgagagggagtcttgctttgtcacccaggctggagtgcagtggcaccatctcggctcactgcaagctccacctcctgggttcacgccattctcctgcctcagcctccccagtaactgggactacaggcacccgccaccacacccagctaatatttgtatttttagtagagacggggtttcaccgtattagccaggatgttctcgatctcctgaccttgtgatccacccacctcggcctcccaaagtgctgggattacaggcatgggccaccaagcccggcccattaagaatttttttttaaggcagggtctcactctcttgcccaggctggagtggaatggcacgatcatggctcactgcaacctcaacctccctgggctcaggtgaccctcccacttcagtgcatcccaccacacatggctaatttttgtattttttgtacagatggggcttcaccatgctgcccaggctgctcttgaactcctgagctcaagtcatctcccatcttggcctcccaaagtgctaggattacaggcatgagccaccacgcccaacctagccaacgattttgtatgtagcaaaactaagtttcataaataaaggagaaataaaatcattttcagacaaacaaatgcttagggaacttgtcactaccagaccagcccaacaagaaatgctaaaagctgttctaaatcctgaaacaaaaggctgatatgcactagagtagaacctcttgatggcataaaactcatggggcatataaaacaataacacagtgaataaaacaaagtatctaggtaacaaataacatgatgactggaacagtacctcacatctctctttttttttttgagatggagtctcactctggcgccaggctagagtacattggcacaatctcggcttaccgcaacctctgactccctggttcaagcaattttctgcctcagcctcccgagtagcttggattacaggtgcctgccaccatgctcagctaatttttgtatttttagtggagacggggtttccccatgttggccaggatggtctccatctcttgacctcgtgatctgcccgcctcagcctcccaaagtgctgggattgcaggcatggcctttttgggtttttttgttttttgcagggaggggacagggtcttgctctgtcacctgggctggagtgcagtggtacaatcttggctcactgtaacctccacctcctgggctcaagtgggcttcccacctcagcctcctgagtagctgggactataggtgtgcaccatcacacccagttaagtttgtgtgtgtgtgtgtgtgtgtgtgtgtgtgtgtgtgtattttttgtagagatggggtttcgccatgttgcccaggctgctctggaattcctgggctcaagtaattcttccacctcagcttcccaaagtgctagcattataggtgtgagccaccaccatacccagcctcaaatctcaatattaatgttgaatgtaaacagcctaaatgcttcacttaaaagatacagattggcagaatgggtctaaaaattgcaaaccaaatatctgttgtcttcaagggacttatataacacataaagattcagataaactcaaggtaaaggagtggataaagatattccatgcaaatggaaacccaaagcaagcaggagtagctattcttctatcagataagatagactttaaagcaacaacagccaggtgtggcagttcacacctgcaatctcagccctttgggaggctgaggcaggaggatcccttgaacccaggagttcaagaccagcctaggcaacacagcaagaccctgtctctatgaaaaaatttaaaaattagcctggtgtggtggtgtgtgcctgcaatcccagctaatgaggaggctgaagtgggacaatcacttgtgtgtcgtaggttcaggctgcagtgagctgtgatcatcccactctactcctgcctgagcaataaagccagaccctgtctcaataaataaataagtaaatagcaacaacagtaaaaaaaaaaaaaaaaaggacaaagaagataattatataatgataaaaggatcaatccaacaagaagatattacaatcctaaattcatatgtaccaatactggagctctaagattcataaaacatttactactggacctaagaaatgagatagacagcaacacaatgatagtggggcacttcaacactccactcgcagcattagacagatcatcaagacagaaagtcggcaaagaaaaaaatggatttaaaactacactctagaacaaatggacctaacggatatttacagaacattctaccagagaactgcaggataaacattcttctcttcagcacgtggaacattttccaagacagatcatatgataggccacaaaataagtctcagtaaatttttaaaaaactgaaattttatcaagtatcttctcagaccacagtggaataaaactagaaatcaactacaaaaggaaccctcagaaccacacaaatacatggaaattaaacaatctgctcctgaatgatttttggggtaacaataaaatcaaaattgaattttaaaaattctctaaggttaatgataacagtgatactaagttatcaagccctctgggttaagcaaaagcagtgctaagaggaaagcttatagcactaaatgcctacatcaaaaagtctgaaagatcacaaattgaaagatcacaaaaagtctgaaagatcacaacctaatgttacacctcaaggagctggagaaacaagaacaaattaaaccaaaagctagcagaagaaaagaaataacacagatcagagcagaaattgaaacaaaaataaacaacacaaaacatcaatgaaacaaaaatctggttctttgaaaagataaacaaaatttataaaccattagctagattaatcaagaaaagaagagagaagattcaaataaactcaattggaaatgaaacagaaatgacaaccgatgccgcagaaacaaaatatcattctggactactatgaacacctctatgcacacaaactagaaaatctagagggaatagatacattcctggaaacatacaacccttctagattaaatcaggaagaaacagaaaccctgaacagatcagtaacaagcagtgagattgaatcagtaatttaaaaattgtcggccaggtgctatggctcacgcctgtaaccccagcatattgggaggccaaggtgggtggatcgcccaagctcaggagttcaagaccaacctgggcaacatggtgaaaccccatctctaccaaaaatacagaaaattagccaggcttactggcagatgcctgtggtcccagctacttgggaggctgacgtgggaggattgcttgagcatggaaggtagaggttgaagtgagccaagatcatgccactgcactccaacctgggtgacagtgagaccccataactccccccacaaaaaaaattgccagcaacaacaaaaaagcccagggctagatggattcatggcaaattctaccagacattcaaagtagaactggtgccgatcctactgaaaccattccaaaagattgagaaagagggaaacctccctaactcattctatggagcctatatcactctgataccaaaactaggaaagggcataacaacaaaaaaagaaacccttaagaccaatatccctgatgaacatagaacacagatgcaaaaattctcaacaaaatactaactaatcgaatccaacagcacatcaaaaaaatacaccatgattaagtgggtttcatcccagggatgcaggtttagtttaacatatgcaagtcaataaatgcgatacatcacatcaacagaattaaaaacaaaagccatatgatgatttcaatagatgcagaaaaatcattcaatataatccagtattgctttatgataaaaatcctcaagaaactaggcatagaagggactcatctcaaaatgataaaagccgtatatgacaaatccacagccaacgtaatactgaacaggaaaagttgaaagcattccccactaagaactggaataagacaaggatgcctactttcaccacttctattcaacatagtactggaagtcccagccaggacagacaacagaaagaaataaaggggatccaaattggaaaagaggaagtcaaactattgctatttgctgatgatatgattgtatacctagaaaaccctaaagactcctccaaaagactcctagatttgataaatgaattcagtaaagtttcaggttacaaaatcaatacacacaaatcagcataccaacaacgaccaagtcaagagtcaaatcattaactcaatccctcctacaacagctgcaaaaaaataaaatacctaggaatatacttaaccaaggaagtgaaagatctctacaaggagacctacaaagcactgcagaaagaaatcacagatgacacaaacaaatggcttacagagtctttatttttttactcagaagcatttcctctgcttccaactgccttcatacttcagtcattgaatttctcgtaagctaggccttttcactactctgcctttatgttaaccattaattccacttaaaacagcaataagaagagattgagggggccgtgcgcagtggctcacgcctgtaatcccagcactttgggaggccgaggcgggcagatcgcctgaggtcaggagtttgagattagcctgctcaatgtggcgaaaacccatctctaccaaaaaatacaaaacttagccgggtgtggtggcaggcgcctgtagtcccagctactcgggaggctgaggcaaaagaatcacttgaacctgggaggctgaggttgcagtgagcctgagatggtgccactgcactccagcctggggaacagagcaagactccgtctcaaagaaaataaataaataaataaataaataaaaagaagagatgcaggggagaaagagaaggctacatttgttgaatatgtattggatgctccacatacaatatcccatctaatttgcacagtaattccatgaagtacgtatactagccaccccttatcaaaggtttccctttcagcagtttcagttacctacagtcaaccacagtccaaaaatattaaatggaaaatggcagaaataagcaattcgtacattgcccaccattctgagtagtgtgatgaaatctcatgctatcctgttctgacccacccagaaactgaatcatccctttgtccagcatatccacctgcctacactacctccctatgagtcatttgccatctgggttagataggctgttgaggttccccaatgcttgtgtttcaaatcactcttattttacttaataatggtcccaaagcacaatggtattgatgctggcaattcagatatgccaaagagaaggcgcaaaatgctttccttaagtgaaaaggtggaagttcttgacctaataaggaaaaacacaatcatatgctgaggttgctaagatctatggtaagaatgaatcttctatctgcaaaattgtgttgaaggaaaaaaaagttcacgcatagtatatacatggtactatccacggtttcagggatccactgagggtcttggaaacccccccctcagataaggggggactactgtagttttatcctctattttgctgatgaggacagtcacgttagtgggattaagtaacctgtccaaggtcacacagctagtaaatggcaagactagcttactagtggcaagtctaaacacagccttttctgtatgctgactctctctctacccactgtcttcatctggcattattgttcagattctactcatcacttccttatcttagcctttgcaacctctctcatttggagttagctgctcccgtaataatccgtctatacttgtctaataataacaggtgtttttttaattgagatataattcactggccgggtgcggtggctcacgcctgtaatcccagcactttgggaggccgaggcgggtggatcatgaggtcaggagatggagattatcctggctaacacagtgaaaccccgtctctactaaaaattacaaaaaaaattagccaggcgtggtggcgggtgcctgtagtcccagctactccgaaggctgaggcaggagaatggcgtgaacccgggaggcggagcttgcagtgagccgagatctcgccactgtactccagcctgggcgacagcgcgagactctgtctcaaaaaaaaaaaaaaaaaaaaaaaaaaaaaaaaaaaaaaaaaaaaaaaaaaaaaaaaaagacatgtaattcacatagggcccggtgcggtggctcccacctgttatcccagcactttgggaggccgaggtgggcggatcacaaggtcaggagatggagaccatcctggctaacacagtgaaaccctgtctctaccaaaaaaaaaaattagccgggcgtggtggcgggcgcctgtagtcccagctactcgggaggctgaggcaggagaatggcgtgaacccgggaggcggagcttgcagtgagccgagatctcgccgctgcactccagcctgggcgacagagtgagactccgtctcaagaaaaaaaaaaagagataaaattcacataacataaaattcatttgtacgattaaagtgtacaacccagtgtttttttttttgtatattcactttgtgtgcacccatcaccactgtctaactccagaacatttccatcaccccaaaagtaaccctatgcccatgatgcagtgattctccatttcacctttcctgccacccctagcaactataatctgcttctgtctctatgcagttgcctattctggacatttaatagaaaagaaataatacattagatagccttttgtatctagcttctttcactcagtttaatgttttttaggttcaggcacattgtaatgtttcagtactttcttccttttaatagctgaatattattccattgtatgaatataccacatgttgtttatccattcatcatttgatggacatttgtttttttctgctttttatctatttatttatttattattgagatggagtcttactctgttgcccaggctggagtgcagtggtgcaatctcggctcactgaaacttctgcctcctgtgttcaagtgatcctctcacctcagactcccgagtagctggagttacaagagtgtgccaccacgcctggctaatttttgtatttttagtagagacagggtttcaccatgttggccaggctggtcttgaactcctgactgcaggtgatctgcctgcctccatctccaaaagtgctgggactacaggcatgagccactgcgcccagtcgttttctgctttttagctattatgaaacctgtgcggccaggtggaggttgtagtgagccgagatcacgccattgcactccagcctgggtaacaagagcgaaactccgtctcaacaacaacaacaacaaaaacctgtgcacgacgttttgtacagacatgtttttaactttcttggagatatacctaggagtatatctggttcttatggtaactctatgtttaacatcttgagaaactgtcaaactgtgttccaaagtaactgtatgacatcatattcccaccagtaatgtatgagagttccaatttctgcatatcaggtaacatttgttattgatcatcttcccattcccaccccaggtttattgaggtatgtataattgacaaataaatgtccatcttttgagtatagcccaacctaacaggtgggaagtagtatctcatcgtgatttttatttacatctccctaatgactaacatgctcattcctcatttgcatgtcttctttggagaaatgtctattcaaatcctttaaccacaatgagaaattatttgtcttttccattgtttagtagtcagagatgtacactttggatagtagtgccttattagccacatgatttccgaatgttttctctcattttgtgggatgacttttcactttcactgctgttctttgaagtactagcattttaaattttgaagtccaatttacctattttttctttttttatttgtgctttaagtgttatatctaataaaccattgcctaattttaagtcacaaaaattttctacgatgttttcttctaagagttttataattttagcccttactaactactaataaaattataaaacaaaattatgaaactaggtttataattttagctctttaactctgttttcagttatttttatacatagtctaggtacgggtccaacttcactcttttgtaggtggatataaaattgtcccagcattattcattaaaaataacagtaaaactattctttccctccattgaattatcttgacctttattatgtggttttttctttttcatttttgctttttactttctctttctcattctacacctttaatatatcccaaattttaaaataaatgttgacacttattttcctacctccatgtctagcatgggactatgatattataacactgcaacaaacatgttcagtgaatgaaaagctgattggagattcctaatgtcaagcaataaataccaaatgtcatagatgctgaagggtgctggggaagttttatatatgaagctgataatccagtgaatttttcaaaccaaaagttttcaagggggtcccagaacttaatcatcttagactggaatgggtcttggagatcatcaaccctctcattttccagtgatgaaaagcagtctttgaaaggctaaatagcagcctatcttatgtaaaattgctatagggtcccagctgtccttgaaattacattctgactattacaagttaacaaaggattctttcagttagtccttgataaagcatttttttcagttctgataaaagtcctttccagttgaaagacaactgcttttgcttcataccacatttatcttctgagataactccgagattattttttaaactcctccaccctagtggaacacttctttctcttaatttctatagatccttcttgctcttctacgaaattagcaatttatttggtattgttctattgctctattgctttagattattatataatcttgaatcattatttgatttatcacagtttttttgtgtggccatccaagtagactaccccaactagaccctgggacagaaatagaattttacaatttattacatgacccacagaggcttgcatcccacagatatgcagcagacatttcttgatactatttgttcattcagacaattcattttaaaaatgagaaactgttaaccctaggtttcattttgttcccccatcccatagagaagtaaggcagttgactcttggatcactcaggatgacagcctctaggggagaaacattttttcatttggaaattttctagtgactcactatttgctttcctaaaggaatggagagaccagagacctaaaattggtgcatatatgtttaagtatttttaaacattactattaaaagtttttaaattatattaaaatgattttttaaaaaagattggcaggtccaggtgtggtagctcacacctataattccagcactttgggaggctgaggcaggcggattacctgaggtcaggagttcaagaccagcctggccaacatgataaaaccctggctttacagaaaatacaaaaattagctgggtatggtggcatgcacctgtaatcccagctactcaggaggctgagacaggagaatcgcttgaacctgagaggcggaggttgcagtgagctgagattgtgccactgcactccagtgtagatgactgagagagactctgtctcaaaaaaaaaaaaaaaaaagcagaattctcccaagaactcagcaaattaaactaactcttaagggaactctgagctgtaattttaaattgctgagtcagaaagtaaagaaagacatcctatgtttctctctctctctctctctttttttttccttttgaggcagggtcttgctctgtcgcccaggctggaatacagtggtgctatcattgttccctgaagcttcaacctcccatcctctagctatcctcctacctcagcctcctgagtagctcggaacgcaggtgcaccccaccgtggctggctgaatgtttctctttttatctctttttttttttttttttaacaaagtcttgctctgtcgcccgggctggagtgcagtggcacaatctcggctcactgcaactttcacctcccaggttcaagcaattctcctgcctcagcctcccgagtagctgggactacaggcatgcaccactgctcccggcaaaattttttttttttttttgtatttttagtagagatggggtttcatcgtgttagccaggatggtctcaatctcctgaccttgtgatccgcctgcctcagcctcccaaagtgctgggattacaggcataagccaccgcgcccagcccctctttttatctcaagtgtgcttcctagttatgagataggggaaagaaatggaataatctagcctcctattgtaataatggaataatctaggctccttgctgaacgtaagtagaatctctggaactgtttgagttaaaatataaaattaagattaaataaaaggtggcagaatgagacaggatgagtatatcatgatatgatgctcagtacactgtcatacatctgtggaaatacaatgaacctattaactgattatgataagaacaaattattgtgggttaaagtgacacccttgtaacagtgaatctagcacatgttattagcatgtttttagaccatggaaaatacaaaaataaataacaaaactaaaaatgttgtgaacttataaatttttttctcatctcccagaaatcagttcctgtttcaaatttatgctattttgaaattatgttaatgaataaaaaaaattgaaacagatgtaaaatcacagagtcatttcacttctctggacttcatttataaaataagggagttagcctagaagttttgctcctcaaactgtaatcaacacatgagcaacatcatcacgtgaaaattggtttgagggccgggcacggtggctcacgcctgtaatcccagcactttgggaggctgaggcagacggatcacaaggtcaggagattgagaccatcctggctaacacactgaaaccccatctctactaaaaaatacaaaaaattagccgggcatggtggcagcgcctgtagtcccagctactggggaggctgaggcaggagaatggcatgaacctgggaggcagaggttgcagtgagccgagatcgcgccactgcactccagcctgggcgacagagcgagactccatctcaaaaaaaaaaaaaaaaagaaaagaaaagaaaattggtttgaaatgcagaatctggggcccaattctagaccatttaaatcagaacttgaaactttaacaaaatccccacctaggttgggcatggtggctcacacctgtaatcccagcactttgagaggctgaagggggaggatcacctgaggtcaggagttcaagaccagcctggccaacatggtgaaaccccatctctactaaaaatacagaaattagctgggcgtggtggcaggtgcctgtaatcctagatatttttttgaggctgagacaggagaatcgctttaagccaggaggcggaggttgcagtgagccgagattgtgccactgcactccagcctgtgtgacagagtgagactccatctaaaaaagaaagaaagaaagaaagaaaaaatccccaccttatttgtatgtatactgaaatatgagaggactaacaaagacaacatagagtaatttccagctagtcgtatctaccattccatgattctgactgaaagatttcaagttacataaaatgagagtcacttacctaaaagttgtgtttgacttgaggacacagactactcagcaggctgaactaactttccaggtcacagctttaaattaacaagggaagcagaaaataaagacttgctctgcttgttgttgctgggttccctcttatcacactaagattcattttaatactcaagtgtatataaaccataggctcatatttgttgagttcctacagttttctatgtgccaaaaagaacttcaaaggtaagtttcctgcctcctgcttgaggcatctaatgacagtgggagctttgctttaaaaggctcagtgtatggagccctgggatgatttaattatagggggcttcctaatttgttattcttatccagaataggaagccattcaattcagtaaaatacctcctgcttgagtcatggggtgaaaagcacagggtgcaggtgaactaaagcagctttatctctagagtgctattcccattgacattgtatacgtgattaggcagccagaaaatcatcatagactatgaactctgctttccccctgatttatctgtggcccaaaataggatatagtttagtttaattcaaggtcagcagaaattcaatatgaaaacacttgagtccattaggaaataggcggaagtggtggagaaaatgagctagtcttctgtgtggggggagcagttagcaactttgttggggggaggcgtttaccctagaggctgtgggagagaactcaataattgaaggaggccattgtggaggtgggtgaggggctgtagcagggatactattaaaataggtttataacttctttctctcttttttttttttttttttttttttgagccagggtctcattctgtctcccaggctggagtgcagtgatccaatctcagctcactgcaacctccgcctctgcagctcaagcgatcctcccacctcagcctccccagggggacgacagggagggactgggactacaggcgcgtgccaccacgcttggctaatgtttttttttgtttttgtttttttttttgagacagagtctcactctgttgccaggctggagtacagtggcgccatctcacctcactacagcctccgccacccaggctcaagcgattctcatgcctcattcttccaagtagctgggactacaggtgggagccaccatcctcggctaatttttccattttttgtagagacggagtttcaccatattgtccaggctagtaatgttttttgtttgtttgtttttgttttttactttttttttttttgtagagatgaggtctcaccatattgcccaggctggtctcaaattcttaggctccttctgcctgggcctcccaaagtgctgggattacaggtgtgagccaccaaccctggactaggtttacattttcaattgaatgtgccaccctcaaaaacaggtctgcctttttaaattggagggtggcttacatgttatggttgattgttgtcagtgacagtgtacttggtgcaaactctttcaacatgtcattttattagtctactttgccttttagtctagccagacacaagtgggttctcaaagaaaagaagaagagttctcaaagaagatgaagtagacttatgtgctgttgcaatttataatttactgacacatagctggcactattttgcattttttctcttcactagcatgtgacctgacatcacatctggattgtaactttcttgaaaaaatggagagggcatagtgcttgacaccagttaaccctgtaagagtcaattatcttgaggtttcttagacttctttgagtagtcagtggctttcattaaatgagtgttccataattcttttttttaactgttgactcctccggttaatggaactccccatctgtggttcattaaaacaaatctcttctttcacttgcttttttgtattaacattgtcctactttttttttttttttttgagacagagtttcgctcttgttgcccaggctagagtgtaatggcgcggtcttggctcactgcaaactccaccccccggggttcaagcgattctccggcctcagcctcctgagtagctgggattacaggcacctcccaccacatccagctaatttttttgtagttttggtagagacagggtttcaccatgttggtggggctggtctcaaccttctcacctcatgtaatccacccacttggcctcccaaagtgctgggattacaggcgtgagccactgcacccagcctgtcctactttacattttaagaattaagcaattaatccaacctcaggaaatccttattaaataaagaatgtcattacccttgtcttacagataaggaaaatgtaccaaagtggtattgttcagtgtcaacagatgttattcaacacctactgtgtgctaggtacagggggcagagagatgaacaaatgacagtttcagctttgtagacgtgcccacaagaaagtaaagtacaggctgggcacggcggctcacgcctgtaatcccagctctttgggaggctgaggcgggcagatcaccaggtcaggaaatcaagaccagtctggccaacatggtgaaaccccatctctactaaaaatacaaaaatcagctgggtgtggtggcgggtgcctgtaatcccagctacttgggaggctgagacaagataatcacttgaacccgggaggcggaggttgcagtgagctgagatcacgccattgcactccagcctgggcagtaagagtgaaactccatctcgaaaacaaaaagaaaagaaagtactatgatactctgcaatatgtactgtaactgatgtataaacagatcacagagcaggagtatagaggaagagaaggagtgaagataatggacacctaacagcctgggtgcaaaggttagtttgtgaatagtccctagagaaggaaagtgaaagtcaggcaaggatagtggggattgagttagggtgggcatttcaggataaccagtgggtcctctgtatatagagacggggatatgtgtcactggcatcaataaatgagctcccctttctgtgattatcagggaacatatgacattaattaattttttatattactttaaattcaaagtaaagggccgggcatagtggctcatgcctgtaatcccagcactttgtgaggccgaggccaggtggatcacctgaggtcagaagtttgagaccagcctggccaacatgctgaaaccccatctctaataaaaatacgaaacttagcaaagcgtggggatgctgtgcctgtagttccagttactcaggaggtgaggcaggagaatcacttgaacctgggagacggaggttgcagggagccgagatggtgccactgcactccagcctgggcaacagagcaagactccgtctcaaaaataaataaataaataaataaattcgaagtaaaacaattacatttcaaaggcaaaacagataaggttcaaactgctatatgtcatcatctgtagtgtgagtgagattgagtaactataatgtaaaaaagtccataaaaagtactcccctataatgtaaaaaagtactccctataatgtaaaaaaggactgaagggagtactcagagatggcttacagataaagttggcaacatcagtggactggtgaaggggatagaataagggaaaaaaggaggcaaagaagtcatggggacatgtgtttgtttgctgtctatgctaactcagtgagattaattaagagaaaaaaagcgaaattctctcatgaacctcagctgtcaaaactccaataagaagttttggtcatttctgggcacagcttctgccctgaagcttaagttaaacagttaatatgatacagtcatatgctttataatgatgttttggtcagtgatggactgcatacaggtcagtggtcccatagctgaaaattcctgttgcctagtgatgccatagtcatcctaacattatagtgcaatgaattacctttttaatgtttaggtatgtttagatatacaaaaatatttgccattgtcttacagttgcatacagcattcactatagtaacatactgtatagatatgtaacctaaaagcaataggctatatcatttagtctaggtgtacaggaggatgtactatctaggtttctgtaagtacactctacgcacaatattcaccagatgatgaaatcacctaacgacaagtttctcagaacatattcctgttattaagcaatgcatgattgcattaagacatgattggccgggcacagtggctaatgcctgtaatcccggtactttgggaggctgaggcaggcagatcacctgaggtcgggagttcaagaccagcgtgaccaacaaggagaaaccctgtctctactaaaaatacaaattagccaggcactgtggtgcatgcctgtaatcccagctacttgggaggctgaggcagaagaatcacttgaacccaggaggcggaggttgcggtgagtcgagatcacaccattgcactccagcctgggcaacaacagcaaaactccatctcaaaaacaaaacaatacaaaaacaaatgatcactggccgggctccctagctcgtgcctctaatcccagcactttgggaggccgaggcaggtggatcacttgaggtcagctgttcaagaccagcctggccaacatggtgaaaccccatctctactaaaaatatcaaaattagccaggcatggtggcgggcacctgtaatcccagttactcaggaggctgagtcaggggaaacgcttgaacccaggaggcggaggttgcagtgagctgagatggcgccactgcacaccagcctgggtgacacagtgagattctgtctaaaaataaataaataaataaataaataaaaataaatcacacaggacctgtgtctattgcttcttttctcattcaccattctccaactaggttatttctttgctccacattaggacaaccactctgatgactataaaatgagaatcttggccaaaatatttaaaatctcttaagcctatgggattaatgaacatcaataaatgagttttctcctattaaaggtatcacagtgagcaacggcaagaataatttagccaagcgcccaatgcttatctccacaagatcacaaaatcacttcaaataatgaagacttctagttaaatacttttctctcctttttatgacattatcacatgctctgtgtaaccgctgaaaaatgctgggttaagggtgacaggcttctgtgaagttgagggtttaagtaagcaccattttaagtacagcagaaataaaatgggctgtgaggcttgttcacaatgtctaccattggcttcccattttatatcatttgattctcagttaagaaacagtcatcaaattttaaagatgatataaggaacatagcaaacacatttttatatttgatccttgctgcctggtatactggtaaagctaattaagactgaatatacaggtctacctattctgattagctattttcttggtaaaacagctgaatttgtagaaaggaaaccaaatttcctgaagatatgattaatcttatgcaagtttccttttttttttttttttattgttttgagacggagtctcgctctgtcgcccaggctggagtgcagtggcgcaatctaggctcactgcaagctccgcctcccgggttcgccattctcttgcctcagcctcccaagtagctgggactacaggcgcccgccaccatgcccaactaattttttgtatttttagtagaggcagggtttcaccgtgttagccaggatggtcttgatcttctgacctcttgatccacctgccttgggctcccaaagtgctgggattacaggcgtgagccaccgcacccggcctgcaaggttccttttatacccttttactcaatcctgttttctttaagctaaagagatggctcaagagtttccagtattttgttaccaaaaatgacataatttctgtgccctgatcatcttgtatgcataattctttctgccttgtatctattttaactatatcatattgactttaaaaattaatgtcagagcacttccagaatgaagacatgatgaactcactagacattttccccagtaaaataatcataacttgtgaaaattataaataaacaatgactgttggatcagtctgtggagtaatttatgccacaggacaatgtcaaaaccactggagcaatcagctagtaattagtagaggctaacagctgggagtgatattaacaaagataaaccatccaaaaacttgacagggagatgaggaaaaaagtcaaagagaacctggttaaaaccactgttggtggagcgcggtggctcacgcctgtaatcccagcactttgggaggctgaggcgggtggatcacgaggtcagaagatcgagaccatcctggttaacacggtgaaaccccgtctctactaaaaatacaaaaaattagccgggtgtggcggcgggcgcctgtagtcccagctactcaggaggctgaggcaagagaatggcgtgaacctgggagatggagcttgcagtaagccaagatcacgccactgcactccatccagcctgggcgaaagagcaagactccatcaaaaaaaaaaaaaaaaaaaactgtcatccctgaggaaggaggaggagagagtcaggataacagtgtgcattgcaaaactgcacttttctgaggagcaccatcagaggctgcacactgtgagggacatagactctgctgaactagtctagccaagtcactaaacaaataaacaagcaaacaacaacaaagacaacaagccctggagacaggggtcagtatccagagttactgcaatggaaatgtacagtgtacaacaaaaaaattacaagacatacaaagaaacaggaaagtgtgacccattcacacagaaactgccttgagaggacacagatattgggtctagcagataaggacttcaaagtagttattataaatacattcaaagaactaaagaaaactatgccttaaaaattaaagaaaggggctgggcatggtggctcacacctgtaatcctagcactttggaaggtcaatgcgggtggatcatgaggtcaagagtttgagaccagcctggccaagatggtgaaaccccgtctctactaaaacatacaaaaattagtcaggcggggtggtgggcacctgtgatcccagctactcgggaggctgaggcaggagaatcacttgaactccggagacagaggttgcagtgagctgagatcacatcactgcactccagcctgggcaacagagcaagactccatcttaaataaataaataaaaattaaagaaaggtatgatgaaaatgttttatcaaatggagaatattgataaagagaaagtttaaaacaaaaaacaaatataaaatctagagttgaaaagtacggaaataaaaaatttggctgtgtgtggtggctcatgcctgtaatcccaacactttgggaggccaaggctggtggaccacctgaggtcaggagttcgagaccagcctggacaacatggtgaaaccctgtttctactaaacatacaaaaattagctggacgtggtggcagacgcctgtaattccagctacttgggaggctgaggcaggagaatcgcctgaacccaggaggaggaggttgcagtgagccgagattgtgccactgcactccagcctaggtgacaagagcaaaactctgtatcaaaaaaaaaaattcactataggggctcaatatgagatttgaactagcagaagacataatcagtgaatatattctgaagaacagagagggaaaaaggaggaaaaaaatgaacagtacatcaaggaaatgtgggacaccattatgtgcaccaacatatgcataaagggataccagaaggatagaagagaaaaagaaacaaaaaatatctgaagaaatgatagctgaaaacttcccaaatttgatgaaaaagtttaatgtaaaccaacatctaaggaactcagcaaacacttaagtaggataaatgcaaagacatataaacacagacatttcaagagcaaaatgttgaaaaacaaagagaatcttgaagtcagcaagagaaacatggctcatgtacaagggaaccctaataagattaatagctgacttctcatcagaaacattggaggccggaaagcagtggtatgacatatttcaaagtgctgaaagaaaaaaacatgaccaagaatcttgtattcagcaaaactatctttttatttatttttattttttatttatttatttttttagagatggagtcttgctctgtcacccaggctggagtgcagtggtgcgatctcagctcactgcaagctccacctcctgggttcaagcgattctcctgcctcagcctcctgagtagctgggactacaggtgcacgtcgccacgcctggctaattttttgtatttttttttttttaagtagagacgggctttcactgtgttgcccaggctagtcttgaactcctgagctcaggcaattcacccacctcggcctctcagagtgctacgattacaggcatgagccaccatgcccagcccagcaaaactatatttttaaaatggagatgaaattaagacatctccagataagcaacaactgagagaacttgctgtgagccgaaacgccttataagaacatgaaaggaagttctccaagctgaaagcaagttatcccagatggtaaatcaaatctacatggaaaaagaaaaaaaaatgataaaagtaattatgtaaataattataagagtgtgtataattacatattttttctcctttctttccttaactcattcaattgtatgaatataattgtatttttggatctgtaacatataggtatgtgatatatttgacaataacttcacagagaaggtaggtaggaataaagctgtactgaagtaaggaaataataccagatggtaaccaatctacaaaaagaaatgaagagaactggaaatggtgaataaaaaggttaacataacaggctttataaatatatgcttgctttcttgtcttgtcttagcttctttcaaatacataaaattacataaataattataacaactggtttgtaacatacatatgtaatatatattacaaaaatattagcaatatgggagggaggaataattatatagaagtaatgtttctatatctcattgggattaattagcatacatttgaggtagatcctgatacgtttaaaaagtataatctagggccggcgcggtggctcgcgcctgtaatcccagcacctcgggaggctaggtgggcggatcacgaggtcaggagatcgagaccatcctggctaacacagtgaaacccaatctctactaaaaaatacaaaaaattagccgggcgtggtggtgggcacctgtagtcccagctactcgggaggctgaagcaggagaatggcatgaacctgggaggtggaagttgcagtgagccgagatcgtgccactgcactccagcctgggcaacagagcaagactctgtctaaaaaaaaaaaaaaaaaaaaaaaaaaaaaaaagtataatctaagccctagagcagttactaagaaaataactcaaaatatgtatattcagaaagtcattgaaggtattaaaatcatccaccagaaaatattcacttaatgcaaagggaagcagtacagagtaacagaggaacaaaaaacacatgagacatagaaaacaaagagtaaaatggtagatgaaattccagtcacataaataacataaaaattaaatgaattaaataacttttttttttttaagatggagtttcgctcttatcgcccaggctggaatgcaatggtgcagtctcggctcactgcaacctctgcctcccaggttcaagtgattctcctgcctcagcctcctgagtagctgggattacaggtggctgccaccacaccaggctgatttttgtatttttagtagaggggtttcaccatattggccaagctggtctcgaactcctgacctcaggtgatcccccccgccttggcctcccaaagtgctgggattacaggtgtgagccactgcactcagccaaataactttttttgtttgtttgtttatttgtttttttgagacagggtctcactcggtcgcccagaccggagtgcagtggcgtgatctcggctcgccgcaaactctgcctcccaggttcaagtgattctcttgcctcagcctcccgagtagctgggattacaggcatatgccaccacgcccgactaatctttgtatttttagtagagacggggtttctccatgttggccaggctggtcttgaactcctgacctgaaatgatccacccgcctcaacctcccaaagtgctgggattacaggcatgaaccaccacacttggccaaattaaataacttaatcaaagatggagattgtcagactggataacaaaacaagttccaactatgtgatattatatatacaggatatacactttagatttaaagacgcaaacagatggtaagttaaaaaaatttttttaaagatataccgtctgggtgcagtggctcacatgtgtaatcccagcactttgagaggctaaggcaggtgcatcacctgaggtcaggagtttgagaccaccctggccaacatggcgaaaccccggctctactacatatacaaaaattaaccaggcatggtggtgcgtgcctgtaatcctagctactcaggaggctaaggcaggagaatcgcatgaacccaggaggtggaggttgcagtgagccgagatcatgccattgcactccagcctgggcaacagaatgagactccatctcaaaaaaaaaaaaaaaaaaagatatgccatctaaacagcaatcttaagggagttgcaatgtctatattactatcagaaaagatagactttaaaacaaaaaatgttagctaggtatggtggaatgcacctgtagtccccactactcaggaggctgtggtgggaggattgcttgagtcaagaagttcaagactgtagtgtgctatgagtgcatctgtgactagccactgcactccagcctaagcatcatagtgagaccccatctctaaataaaataaaaacaaaaaagacagaaagattactagaaataaattgggacattttataaggaaaaaagggttaattccaaagtattaatatataacagtcaaaaacacatatgcccctaacagcacagccctaaaataaatgaaacaaaactaacagaattgaaaggagaaatagactcttcaacaattatggttggatactgcaatatcctactttcaatactaaatagtatgactaggcagtaggccaactaagatatagaagacttgaacaacaagataaactacatttattaataacagatatctgtagaaaactctacctattaacaactgaatacacattcttctcaattgcatgtggaacattctcccagaagaccatatgctagacataaaataaggttcaataaagttaaaataattgaaattatacaaagcatgtcctccgagcacaacacaatgaaattagacattgataacagaaggaaacttgggatattcaaaaatatgtgcatattaagcaacacacttataaaaagacaaaatcacaagggaaaatggaaaatactaagaaatggatgaaaatgcaaaaacagcataccaaaatttatgagatgcaactaaagaagtgtttggagtatttcttttgatagctataaacacctatattaaaacagaagaaagatctcaaatcagtaacttaaacttccatcctaataaactggaaaaagaaggacaaagtaaacctaaagcaacaagaagtaaataaataacaatgattagagcaaaaattaataaaatagagaacagaaaataatagagaaaaatcaacaaaaccaaaaattggtctttgaaagatcaacaaagttgataaattttaactcaccaagaaaaaaaagaagaccaaattactaaaatcaggaaagagggaacataactaccaacttcacagaaataaaaagaattcttaagaattattaaattctaatattaaagaatactataaacaattatatgtgaagaaattaataaatgaaatgggccaattcctagaaagatacaatctaccaaaactgactcaagaaaaaaatagaaaatctgaataaacctataacaaaaaaagcaattgaatcagtaacttattattattatttttttgagacaggctttcgttctgtctccaaggctggagtacagtggtgtgatcacagcttactgcacccttgactgcctgggttcaagagatcctccagcctcagcctgctgagtagctgggaccacaggcaggtgccaccacacctgctaattgtttaaattattagtagagatgaggtcacattatattatctaagatggtcttcaacttctgggcgtaagccatcctcccacttcagcctcccgaagtgtttaagatcttcttttttattttttattttttgagacggagtcttgctctgttgccaggctgcagtgcagtggcacgatctcggctcactgcaacctctgcctcctgggttcaagcgattcccctgcctcagcctacagagtagctgggactacaggtgtgcgccaccacacctggctaatttttttgtattttagtagagacgagttttcaccatgttggccaggatggtcttgatatcctgacctcgagatctgcctgcctcagcttcccaaagtgctgggattacaggcatgagccactgggcctggccaagatcttcttaacaaagaaaagtgagaactggatggcttcactagtgaattttcttaaaaattcaaataagaattaatactaattcttcacaaactattccaaataacgtaagaagagggattactttccaactaattctataaggatagttaccctgataaccaaaaccaaagtcatcacaagaaaaacagaagctacagaacaataaccagtatctgttatgagtatagaggtaaaatttctcaacaaaatattaggaaactgaatccagcaacatatgaaaaaattatacactataacaaaatggaatttgttccaggaatgcaaggttggcttatctccaaaaatcaattaatgtaacacaccatatcacacaataagaaacaaaaccacatgattatctcaatggacataggaaaaacacttaacaaaactcaacaccctttcataataaaaacagcaaactaggaatagactgacgctcaatgtgataaaggacacacacaaaaaacctagagcaatcatcataacacttaatggtgaaagactaaaagctatgcacgtaagactgggaacaagacaagaatgtccacacttcttctatttacttatttttttttgagacagggtctcactctgttgctcaggctggagtgcagtggcacaatcttggctcaatgcaacctccacctcctagtctcaagcattccttccacctcagcctcctgagtagctgagactacaggcatctaccaccataactggctaatttgtttttatttttattatttatttttatttttattattatatttttgagacggagtctcgctgtgtcgcccaggctggggtgcagtggcgcgatctgagctcactgcaagctccgcctcccgggttcatgccattctcctgcctcagcctcccgagtagctgggactacaggtgcccgccaccacgcctggctaattttttgtattttagtagagacagggtttcaccgcgatagccaatatggtctcgatctcctgacctcatgatccacctgcctcggcctcccaaagtgctgggattacaggcgtgagccaccgcacctggccttgtttttatttttaatagaggtggggtttcactatgttatccaggctggtctcaaactcctaggctcaagtgatccacctgccttggcctcccaaagtgctgggattacaggcatgagctactgcacccagcctcttcttctatttatcttggtactggaggttctagccaatatgatcaggtaacaaaaagaaataaaaggcatccagattgaagaggataatataaatctaactgtattttattttattttattttttttgagacagagtctcgctctgttgcccaggctggagtgcagtggtgcgatctcggctcactgcaagctctgcctcctgggttcacgccattctcctgcctcagcctcctgagtagctgggactacaggtgcccaccaccacacctggataattttttgtattttttttagtagagacggggtttcactgcgttggccaggatggtctccaactcctgacctcgtgatccgcccgcctcagcctcccaaggtgctgggattacaggcatgagccaccacacctggcctcattttatttgttttttaatctgtattttaaaatgacagtcttggctggtcacagtggctcacgcctgtaatcccagcactttgggaggccgaggcgggtggatcacgaggtcaggagattgagaccatcctggctaacacagtgaaaccctgtctctactaaaaatacaaaaaattagctgggcatggtggcgagtgcctgtagtcccagctactcaggaggctgaggcaggagactggcatgagcccaggaggcggagcttgcagtcagcccagatcgtgccactgcactccagcctgggcaacagagcgagactccatctcaaaaaaaaaaaaaaaaaaaatgacagtcttatatgcaggaaatcctaaggaattcacctaataaacaagttctgcaatacaatatcaacaatatgcaaaaatcaactgcatttctctatagtagaagtgaataattcaaaaaggaaactaagaaaacaatttgtttacaatagcattataaagaataaaatatttaagagtaaaagaagtgcaaaatgtatactctgaaaatgagaaagcaattgaagctgcctaaataaatgaaaagttatcccatgttcatggattggaaggtttaatactgttaacatgacaaaaaccacacaaactgattcacagattcaaggcaatcgttatcaaaatctcagctggctttcttaaagaaattgacaagttgatcctaaaattcacatgaaaatgtaagggatccagaatagccaagacactcttgaaaaaaaaaaaagttgtaagactcacacttccttgttttaaaagttactaaaaaactacagtaatgaagacactgtgattattgtcaaaggatagacaaatcaatcaatagaatagaatttaaaatccaggaataaacccttaaattttggtcatttgatttttgacaattgtgcaaacaattaaatgggagaaaaatagtcttttcaacaaatgatggtgggataactgaatatccacatgcaaagaaatcaatttggaccacttacattagacacaaaaattaacccaaaatggatcataagctaaaaagtaagagtttaaactataaaacttctagaaggaaatataggtgtaaatcttcatgatcttagattacacaaagccctcttagacatgacactaaaaacatatataacatatagtctggcacacagtaaaacaaacaaaaaccatacgtgacaacaacaaaataaattagacctcgtgaaaattaaaaatttttatgctgcaaataataccatcaaaaatatgaaaagattaaaaaaatgaaaagataatgcacagagtgggagaaaatatttgcaaataatctaataagagatgtatttccagaatatataaagagctctggccaggcatggtggctcacacctataatcttagcactttgggaagtcaaggtgggaagatcacttgagcccaggagttgaagatcagccttgacattataggaagacctagtctctacaaaaacgagaaaaacaaattagctgggtgtggtggcatatgcctatgggcctagctactcagtaggctgaagtggaaggatcgcttgagcccaggagttggagagctgtgatcatgccatgcactccagtctgtgcaacagagcaagatcttgtcttgaagaaaaaaaaaagaaaagagagaactcttacaactcaatgaaaaaagacaacccaatttaaaaatgattaaaggatctgaatagatagttctccaagaagatatataaatggccaataaaaacacgaaaacatacccaacatcattagtcattagggagatgtacatcaaaactgtaatgagataccacttcacaaccactaggatggttatgataaagaagatgggaaaaaaaccaagtattggcaaggacattaaaaaaaactgaaaccttcactgggtatggtggcttacacctgtaatctcagcactttgggaggctgaggcaggcagatggcttcagtccaggagattgagaccagcctggacaacatggcaaaaccccggcgctacaaaaaacacaaaatttagcagggtgtggtggcacatgcctgtagtcccagctactagcgatgttcagaatagaaaaactcatagcaacagaaaatatattattggttgccagaggttgaggagagtggggagtaactgctaatggatatgcagttactttcagggtgctgaaaatactctggatttaggtagaggtgatggttgcaaaactttgtgaagatacttaaaactatcaaattttacactttaaatgagtaagttgtatggcatgtgaattatctttttttaaaaaaatgagacgggatctcactgtgcattgtgttgcccagggacggagtctcgctggagtgcagtggtgcagtctcagaggctcacagcaacctctgcctcctgggtttaagcgattctcgtgcctcagcctccggagtagctgggattacaggtgcccgtatattttataatatattccataattaatcgctccgtattaaacttgctgatgcaggtctccaattactgaaaaacctgataccaagtttttcaatgggatttttttgtttgtttaagagatggggtctcaccatgttgctcaggctggccttgaactcctgggctcaagtgatcctccagcctcagcctctcaaaggctgggactacaggcatgtagcactttgcctgactcaaggggaatttttagtaagagtatataatccaagtctgtagcagttggaggatgtcgtaccacgctgaagtgtcacacataactgatgactcagtcccccaagcctattttatcatcgtaaagaaagctatttctttgattattccaactctttcagcaccaggactgctgcaggggctggattcatgctacctgtagttgcagtgtaaattatgtgtcagagccaagatcctaggaaagtcaaagactaggttacaagagcgattctttttttttttttttttttttttttttgagacagagtcttgctctgtcgcccaggctggagtgcagtggcacagtcttggctcactgcaacctccgcctccctggttcacgccattctcctgccttagcctcccgagtagctgggactacaggcgcccgccaccacgcccggctaattttttgtgtttttagtagagacggggtttcaccgtgttagccaggatggtctcgatctcctgaccttgtgatccgcccgcctcggcctcccaaagtgctgggattacaggcttgagccaccgcgcccggccaaggacgattctttctaatctttggtaagccagtttttacagaatgaaatgctcttggattgactgacttgattgggtaagtattcattgggctcttgttccatgcaagggcagtctacaagggcctagatatgggggcccccaaagaagaaaaatcggtttttcatcatattttctggttgagtttcttcctttattatatttgttacatatgttattaaattatttccataaaagaggttatgctgagcaggtaaccaaattcttgttcccccaaaagacatgtataattcagacgatttatgcaattagaagaagggagacttcatcagttaataaagtctagaacgtgaggaagcccagtcatttccaggaccttcagatgcccaagctggatccaggttttccaccccgacagctccagggagcacgctggagagacagacttcaccagcgggaaggcgcggcaccctacgcgcaaggaacctcaagtcccagaatcctatgaggactccaaatcccagaaacctgcacgcaaatctatcccgggtgccaagtcggccgaccgcagacgtgaccaagttgcgaggctagggtgaggtgtcgtagaatttgtccctaccattgtccctgcagggaagagactttagtgatctagagctggtcattgtctctttcacagctcgcgtgaaagcacccctctcggcgtgtttgatgccatgatcagcgtctcccattccctctgtcccctttctctgcccccgtaaggatggttcagcccggtattgaggctccttgagctggctggatggttgcgcccgccctaccccggaatgtgggcctttggagcgagcgaagtgggagggaccgacgcaggaggtgtcttgggcccgggcggctgtagaggcggcggcgcctacgggcagtgggaggagccgcgcggttccggctgctccggcgaggcgacccttgggtcggcgctgcgggcgaggtgggcaggtaggtgggcggacggccgcggttctccggcaagcgcaggcggcggagtcccccacggcgcccgaagcgcccccccgcacccccggcctccagcgttgaggcgggggagtgaggagatgccgacccagagggacagcagcaccatgtcccacacggtcgcaggcggcggcagcggggaccattcccaccaggtccgggtgaaagcctactaccgcgggtgagtgtcctgggacagggcggtgggcgggaggggacaggccggctccactcggcctggaggaggggagggtgaggggctggaggtgttgtgggcggattgggctgggcgggcgggcggctccggtgactcagggtgagtgacgaagtgataggggtgggggcgaagcaaggggatgcagtactgggggcgcccccaggtatggcggtgcggggagccgaggggccagagtagggtccgagaaggaagctagggttagagtaggtgcacctggtgtggacgagagactcgcctcctgagagctttgtaggggccttgcatccttaagtctgggtgtatttggggttgcgagttgaggattccaagtgatgccttagttaactcagtttgctgtggggatagaaaacgggacttcttcagttagctgtccgttttgattaccagcaggcctaacgcctctggttctctgagatatacctccatccccgttgtgttcacgtagtgtatctgcactgccagtatattagacataggggttgtatttaagaatcaagtcgatgcgttttcagggacgtgcagtgggtacttacgtgtcgtcaagattaagttgcatgtgtgtaaatcaaaattttgtgagcctttctttctcagtgttgtttcaacgactacccgatagggtgagatactgcaaggtgaggagactagcctagttacagttttaaattctctgatcttcactcccttactatggttacaagaaaaaacccagttctaagttcattgtgttaaatcattttctatcagtgacgcaaagtgccccccttcctttaaattcagttgtggtttgaatttttttttgagataattatgtttaggagcattagaaacgtgaaatgttagtgtgaccataaaggttggagactgagaagtcacagaaaacccagctactttggcttgccttactgcttgtccaggtagaagtaaattgctttaaaaaactcaagcagtgctaggttgaaattttaatgcatacttttacattcctgagaggatcagtgaagatagcaaactctcaaactacctctcttgttttgatttcaaagaaaatctgagcccctaaatgttgtattgatttgatgtaaggacttttttttttattattatactttaagttttagggtacatgtgcacaatgtgcaggttagttacatgtgtatacatgtgccatactggtgtgctgcacccattaactcgtcatttacattaggtatatctcctaatggtatccctcccccctccccccaccccacaacagtccccagggtgtgatgttccccttcctgtgtccatgtgttctcattgttcaattcccatctgtgagtgagaacatgcggtgtttggttttttgtccttgatgtaaggacttttaaatttgctgccatgaagcctctggcctctgtttattattagcttgactgtatgcaggagtagtttattggagttatattggacagtatgataactttgtgtttaagcaggtaaaactgattaaggaggtttttattttaaatcagtaccaagaaacgtgtggatattttttaaagtttgtagttgtcacaagagctgttttgacttgaggatggtcagccatgaactttgcaaggtgagaaaaaagcttcctttgcttttttttttttaaacccttacctgtaatttgatgaatgagatgtttcactttattcttttattttatttttgtttgtttgtttttgagacagggtcttactctgttacccatgctggagtgcagtggcacaatctcggctcactgcattctccgcctcccgggttcaagcaattcgcctgcctcagccttctgagtagctgggattacaggcatgtgccaccacacccggctaatttttgtatttttagtagagacggggtttcaccatattggccaggcatgtcttgaactcctggcctcaaatgatgcgctcgtcttggcttcccaaattgctgggattacaggcatgagccactgcgcctggccctaaggctttcaataaattcttattaattgagatcatcttctccaatgagtctatgaaaggtaagaaattagtgcttctattttcccatttgtattagtttgacacatgtaaataggcccagttagtaaatgaaaatcattgtaaactcctttgagaagaaatcaaagtcttgctgtacttcatgaatttagatagcaaattatcttggcttattgctccagttattaaaaagaagagaataaggacatacagcttctttagtgtttgactgcaatttttccaagacattcaaggtaacattgtcttttaaaatctgtgaaattttgctgcggcgcaaataacctcttgcccattgtatactggtctttgctcaatgaaagctttctaatggtaccttcatttcaagcctcatttaaagacaatatcagcactctaaattgtaccaaattcctgtcctctgaaattagatgttaagattatgtgtttgtatagtctaaactgatgattgtggtattacatagtcagctgctcattaatatagatgaagctaaaatgagtcacggacaaggatagttaataaacaggttggctaactagaacacctacctgattttaaaatagaaaatccttcctttataccaagaaatgtgagaacattctgcatttgaaaaagttttcttttctctccaatcttctgaagggccattattacatagcatttcctctatccctctacacttttcttttcttttttttttttttaaatagagacaaggtctcaccgtgttgcccaggctaatcccaaactcctgggctcaagtgatcctcctgcctcagcctctcaaagtgctgggattacaggtgtgagccactgtacctggctccactacccttttctaacaatatttctttccagtgaatgttgactcatttaatagccagcattttttttagtgaaaaaattgccctctcttttcaaagatgtgtatagtgttattattctgttaagcttgatctcagtgaaaacgtgtaatctctctagatctaataacatttaatttttttctaatttttattttattttattttatttatttatttttttggagatggagtctcgctctgtcacctgggctggagtgcagtggcgtgatctcggctcattgcaacctccgcctcccaggttcaagggattctcctgcggctgcctcccgagtaggtgggactacaggcgcccaccaccacgcccagctaatttttgtattttagtagagacgggttttcaccatgttggccaggttggtctcccaacttctgacctcaagtgatccacccacctcggtctcccaaagtgttgggattacaggaatgagccatcttgcccagccaatttacatctagtttttaagcaagagattaatagcactgaaaattcaattttattggacaccacatcttacttagatgcctttctcatggcctgcacccgtcttttcctagcaaggaagcttttcagtgaggggccttcagttattacctagtgctagtagtttggaggaagagaaacaggtttcattaattagtgataaactgtcaatgtatgtgcttatccttatataaaattacttgctattatgggatagactttaacaaggcaacatctggactgctcatttctttacattatatatgtatggaaatttttgcagaaagcttgtgaaagttctttttaaaccgctgctgtcaagtagtaataacaatacagaggattccttctgtgcacatctagaaataaaagattaactctttgcatatttggaatagctgcttcagtgaagaagtatgtaggatttttcttactgtgaacaagtcttggcaagacttgtttttgaaagaaatgcaagattattttagcaatatactttagtaatggttctgaggaaatacaagtggtatcttgagggttggggggatgttagctaattggtcttagagcttcagccatggcacctaatcctagggcagctgatccatagcttggccaaagagagaaaaaaatagagcatgctagcctggtgccaaaaaacccaaaccaaacacaaaaaaccctcagaaatttgaatgagaaaatatggagataaaattggtcagcactgggaactgaagctggagttggagggagagtctggcgaggccagaactgacaatgtgcaaatgaaagatgtgaagaagcagaaactgaggaagcaaaggagaaaggagcaactctgcacagaaaaattctccccacaggtccttagttcatgatggctttctaatgcaactgcagccctccttttacaactttagtgtctgttttttttatgattgaaatgagcctaatttaaacatagattttaaaaattccagtcttgcttaagatttcaaatataaccagagatcattcaaactgagtttagtaaatattgttgaacgtccgtaatccaggcacatgatgctgtcgtaggcacagagaatgtagaggtaggtaaggctctgcctttaaggaattaagagacttgtggagggaaggacatataagagttacaatagaaacaatttaatttgaagtacctatgtaaggtatttgcaggaatagacgttggggaggagtttggggtgatggaagccttcctagaggaaatgtctgaggcttttaaaggataactaggagtttgcctggtgaataatgatgttaggtgggtgttataggcattaaacaaccacatggtaagtttgcagaattaagatcactttggctgttagtctcatattcattccttattaggatataaagtatgaagtgggcactgatgagaaatgaggctaagaaagttcacaggggctagattgtaaagacccttgaatgtcatactgcagagtttagactttttctcattgatgaaaattctaagtaagagaaatacatgatcagatttgcattttagaaagataacacttgaaattagtatgggagatggattggtgatggatgaaactaatttggaggcttttgaagtagtccagatgagatattttaaggagagagaaaagagtgtatggattcggtggaaattttaaggggtagtatcagtagaattaaagatagtcttgtaggggtgacgggagttggacaactcataggtttctcgtttaagagagactggggaatgtggaagagatttgtgggagaagttaattaattggctggaacaattcactgaattttgagttctaggtgtttatgaggcattcaggaggaaatgtcagaaagaatggagcaattatttattgtctgtctactctgtgttgcaagcactgtgcttgacagctaacctatgtaggaatgtggctgagaacgataatagaaacaaaaatgacaccagtggccaaatacagatcacaaaggcaaggcactaaaactaaattttaaaaatatagaaatacagaaagaggctgggtatggtggttcatgcctgtaatcccagcactttgggaggtcagggcaggtgaatcacttgagcccaggaattggagaccagcctgggctgaatgtggtgaaaccctatctctacaaaaaaattagcctgtagtcctagctactaggagggcgaggtgggagaatcacctgaggccaggaagtcaaggctgcagtgagctgtgattgcaccactgcactccagcctgggcaacagagtgagaccctgtctcacacacacacagacatacacacacacaaatatatatatatatacacacacacacacacacacacacatatacatacacacacatataaagttcccctgtagtctctcactcccaccttattttattttattagtttatttttatatatttaaagggtacaagtgcagatttctttctttcttacatgtttgtatcatgtagccatgaagtctggtcacttagtgtacccatcaccggaacagtaaacagtaaaacccagaaaattacctgtacccgataggtatttttcaaccctcacccccctcccaccttttgtagtctccaatgtctactattccctctttatgtccatgtgtaccctttgtttagctctcacttataagtgagaatatgtggtatctggctttttgtttctgatttttttgactagggataatggccttcagttccatccatgctggtgtagaagacgtgatttcattattttttatggctgtctcactcccactttctagagatagccattgttaacagttagggatattctatatcatatcggtatatttataagtatagatatgtatgtgcatacacacacacagacatacccttttatttttccaataaatgagttcatatttccacacatgcatctgcaacttgattttaaaaatcgtggtcatcttttcattccagggtagacagacctctttatagttggtaatacagtgttctacagttgttgttgttgttttaagagacagagtctgattctgttgcctacgctggagtgcagtggcatgatctaggccctctgcagcctcaaccactctgggttcaagcagtcctcccacctcagcctcctgagtagctaggattagctcacgccactaggctcagctaattttttttaatatgttttgtagggacggggctggtctcaagctcctgtgctcaagtgattctcctgcctcggcctctcaaagtgtagaaattacaggcatgagccattgcgcccagccaccataatatgtttaatcttttttcggattgatgaacatttaaagttgtcttcatcaactcactatttcaaataatgttgaaggaacctccttatatttaatacatattcttgtaaatatggtcaaagatatgcctatcttgaaatatgatattgtttcccaaaagagcttaatttacattcttaacaacaggactagtgaagcttctgccttatattcccattgcatgttatctgtcttttaaatttttgactgtcagattggcaaaaaatggtaatttatttttacaagtatcttttatatattaatgatcatttgtatttcttctggattgttcctattttacccattttctattgtattatttttcttattaatttgttgacaggacattgacattttgttaaagttgccagcatttccccaatctgttgctagtctggagtttttcgtttttatgtcatcaaacctgtcctttttaaaaatttccttgatagtttctggatttactgtcttaggtaaaagtgtttttcatctaaaaatattctatttttcttctattatgcaacttttttttttttttttttgagacagagtcttgctttgttgcccagggtagaacccagtggcgtgatctcgtcttactgcaacctttgcctcctgggttctaacaatcctcctgcctcagcctcctaagtagctgggattataggcgcacgccacaacacccggctaatttttgtttgttttttgagacaaggtcttgctcagtcgcccaggctggagtgcagtggcacgatcctggctcactgcagcctctgcctcctgggttgaagtgattctcctgcctcagcctcccaagtagctgggattacaggcatgcgccaccatgtccggctaattttttatttttagtagagacagggttttgccatgttggccaggctggtcccaaactcgtgacctcaagtgattcacccgctgtggcctcccgaagtgctgggattttaggcgtgagccactgcgcctggcttattatgaaacttttaaagtgattatcttttcagtgaatctggtattttggggtttagtcatttatagggtactgacacaactttttttttctccaaaatttattctaataccattattgggcagattgtcctttcaccactgatttgaaatggtaactctgttatgtactaaatttcccacaatgtgcgtaggtactttctattgtttcattgattttaggggagagatctatttttgcacataccactattggtttaattattgtaatattatagttaactttgatatatgttatggaatggcttgattcattatttaattttttttttttgttttttttttttttgagatggagccttgcactgtcacccaggctggagcgcagtggcgtgatcttggctcactgcaacctccgcctcccaggttcaagcgattctccagtctcagtctctcaagtagctgggattacaggcaaggcgctaccatgcctggctaatttttgtatttttagtgaaaatggggtttcaccatgttggccaggctggtctggaactccttacctcaggtgatccatctgcctcggcctcccggagtgttgagattacaggcttgagccaccgtgcccggcctattcctatatattttataatcatgtgcttttgtgaatggggtcttcttgtagacctattacatactgttttctttttgtatgtttaaattaaactttccaccttactaataatttaactgtcttagaatttttaagctagataatgtcatctgcaagtagcaattttgcctcttcttttctatatcttatttatttatttattatttattttatgttttttgagacagagtctcactctgtcgcccaggctggagtgtagtggcgtgatctcggctcactgcaacctccgcgtcccaagttcaagtgattctcctgcctcagcctcctgagtagctaggattacaggcgtgcaccaccacacctggctaatttttgtagttttagtagagatggggattcgccatgttggccagactggtctcgaacgcctgacctcaggtaatccacccaccttggcctcccaaagtgctaggattacaggtgtgagccactgcgcccagccttatttatttttagccataggctagaattttctagacagtattgaattatagtaataatctcttatcttagtgaaatataatagaaaaatttctgtcaattaaagaaaaaagcttttaaagaattaaagttagtgttattcagaaatgttactgaggccgagtgtggtggctcacgcctgtaattgtgccactgcacttcaacctgggtgacagagcgagactctgtctcaaaaaaaactcaactgaaaaaagtggaacaaaagaaaaagaaccatgataagtattttgcactttttttttttttgaggcacatttctactctgtcacccaggctgagtacagtggtgtaatcacagctcactgcagccttaactgcccaggctcacgcagtcctcctacctcagcctcccaagtagttgggactgtaggcacacaccactatgtctggctaatttttaatttttttgtagagacaaggtctccctgtgttgcccaggcaggcctcgaactcctgtaccgaagcgatcctcccacattggcctttcaaagtgctgggattatggcatgagccaccttgcctggctgcactcatttattttcatttatttttcattttttgagtcagtgtcttcctccatcacccaggctagagtgcaatgacatagtcacagctcactgcagcctcaacttcctgggctcaagctgcacttatttagtcttcatgataatactcagaggcagatatgattatctccatttttcagataacattgagacttactaacccacaatacaaagctgggtgtgtttttttttttagagacagagtcttgctctgtcgcccaagctgaagtccaatggctcgatcatggctcactgcagccttgaactcctgggctcaaatgattctcgtgagtagctgggactacgctatgcttggctaattacaaaaaaattttttttagagacagggtcttgttctgtcactgaggctggccttgaactcctgaggtgatcctcccgcctcagcatcctgagtaggtgggattacaggcacgagccaccttgcccagccaaaactggaccttgaacttcaaagagatttctcttttccccttactacattgacagggctttataacattgcttttttactttattgttacattcatatttcacaattgttatttttgaattcactatcttcttcattattaaaaggtggaaattgctttatgaccttttttataattaataatttggggggtgatactttgagattatatgaatactctagtcccccaaaacattttgcccaatggtcttaccattcatggataatcctgcctaaaccaattattataatggttattgcaaataaaagtattttttcgaatagcctaatttagaagaaaagcttacactgaggtagcagaaggactgaatgtgattcttttgggggtttatttttaaaagcaattagtcctaaggaaaaactttataatagattctatattttagaatataggcacattgaaagcagtttgtcttctgaagctcaatagcaaaataaaaaatgcttaaaaaaattcagctaaaaccatatctaaatttgccattttgggaatctttgtgataaagcagattatattctgttgaggatcagtggtaaaataatttatgctagtgctgaagttaaactggaaaaaacatcatacgtgcataatttgttttatacctttagaatgtaatatctttattttgcagttcatttttagctttggtactgtaacaaggatctggtgattgtggaatgttatgaacatagtggtttcgcaattactgagagctaagtgtttatataaaactcccttgaatgttttagttcctggaacttaaggagtggtagttgataaagcataactccttcattgagtctctgatgggtatctatacttaaacttttttttttttaaacagaatctcactttatcatccaggctggagtgcagtgacgcaatcacggctcactgcagcctccgcctcctgggttcaagcggttatcctgcctcagcctcccaggtagctgggattataggcacccaccaccatgcctggctaatttttgtatttttagtagagacggagtttcactgtgtttgccgggctgatttcgaactcctgacctctagtgatccgcccacctcagcctcccaaagtactgggattacaggtgtgagccaccacacccagcctatacttacactttttttttttttttttttgagatggagtttcgctcttgttgcccaggctggagtgcaatggtgtgattggttcactgcaatctccgcctcccgggttcaagcgattcttctgccccagcctcctgagtagctgggattacaggcatgtgccaccacacccagcaaattttttatttttagtagagtcagggtttctccatattggtcaggctggtctcgaactcccaacctcaggtgatccatctgcctcaggctcccaaagtgctggggttacaggtgtgagccaccacgcccagccttatacttatactttttaagtattacacagatgtcttaaaagtatttgtatgttctgataagtgttttttagcttttgaaaagtaaaatttatgaaaaagccttgttgtttacaaatatgtttacctttctgttaattttaaatgtggactttgataaggaagttatatttcgatgatatccagtgtaactaattttttccctcttattcaagaaagataattttacacttattctttgacagagaaatttcatagaattttcttcttctaatttaattccagaatacattctctcaaccctatgccctcatactagtaaccttgagggttctttgaaagaaaaattgctttaaatcaagcaattctcttttgtcattaaaataagctattttctatttttatttttaaaaactatttaaaacaatataattatgcaagtgtgtatatatgtatttgatttttttgttttcttttgtttttatttatttttttgacacagtctcctctgttgcccaggctggagtgcagtgatgtgatctcagctcactgtaacctacacctcccatgttccccccctgagaaggatcctcccacctcagcctctggctaattttttttttgtatttttagtagagacggggtttcaccatgttgcccaggctggtcttgagctcctgggctaaagtgatctgcccagctcagcctcccaaagtgcatgagccaccgtgcccagcttgatattttaatttttacttgaatgaaatcatttactgaaagcaatacatgttgatgcacacacaaaattactgaagttcatcaaattgtcaagcattcagtaatatatacagcattattatttttaatcattttcaaactgaaaactccttttctttttcagggatatcatgataacacattttgaaccttccatctcctttgagggcctttgcaatgaggttcgagacatgtgttcttttgacaacgaacagctcttcaccatgaaatggatagatgaggaaggtgagtggtaaagacagggctgcctgtgtaagcattttaagatcttattctatcatttgttgtaaaaatataatgagtcctaaaaagtttaagaggaaagactattagaaatttgatgccattcttgttttttctttaagtatttaaaagaatactgaagagcacaatcttttttttgccccttttacgccaaaatgatgtgaaattaacttgactttttttttttttttttgagacggagtctcgctctatcgcccaggctagagtgcagtggcctaatcttggctcaccaaaacctccacctcccgggttcaagcgattctcctgcctcagcctcccaagtagctgggactacaagtgtgcaccaccatgcccggctaatttttgtatttttagtagagacgggggtttcgctatgttggccaagctggtctcaaactcctgaccttatgatctgcccacctcggcctcccaaagtgctggcattgcaggcgtgagccactgtgcccagcctaacttgacttttttaagcataaggtaagcatctcatcaaatagtgtgatgttttactttaattttgttttttctttgaattaaattttttttttttattttttaaagacagggtcttgctaagttgtccaggctggtctccaactcctggcctcaagtgatcttcccatcatgacctcccaaagtactgggattgcaagcaggagccactgcattcagcttcactttattttttaatttaaattttttttttttgagacagagtctggctctgtcgcccaggctggagtgtagtggcatgatatcagctcactgtaacctccgcctccaaggttcaagcaattcttgtgcctcagcctcccaagtagctgggatacaggggtgcaccaccacacccagataatttttgtatttgtagtagagacggggttttgccgtgttgcccaggctggtcttgaactcctggcctcaagtgatctgcccacctaggcctcccaaagtgctgggattacaggtatgggccaccacacctggcccccagcttcactttaattttgaatatgtgttgtcttatattttaatttaagagattacctatttttaagctgaatattaccttaaagaaaatattgtggaatgaaagtgattttgacaatcattatttcaaagtagtggcagaaacctgatacctcagtgacttgtactcagaaaacatttatcatatatgtaggcttacgcctgtaatcccagcactttagagtctgaggtgggaggattgcttgaggccaggagtttgagaacagcctgggcaacattgtgagaccctgtctctacaaaaagtttttaaaacttatctggtggtagcgtgcacctgtggtcccagctacttgggaggctgaggtgggaagattgctcgagcctggaaggtcaaggctgaagatgggccctgattgtgccactgcactccagcaacaaagcaagcaaagcaagaccctgtctcaaaaaaaaaaaaaaaagaaagaaaaagggaaaaagaagcaaatatctgtgtgctgaggacagacatttcctatcctcaaacccatagtctgatagggagatggacacatgtgtaacaaatgtgataaattctggaacataaacgcataggggccttgaggaatacaaaggaagacacatctataatacatctgcaatgtttgacataaacctgtaacagagtagaagtttttgaggtagaggaggtgaggagaaaaccatataggctgaagaagaatatgtagaaaggcacagaaatgtgaagaacatgatgagtgaaaagcagtaattcactgtatctgaagtatgaagtggtgaagtatgaattggcctacagtttaacaggctccacgggtgagttgtatgaatacagaaatttgtttgagaagcatgagactagatccccaagagctttgcagatcacattaaattttattttacatgactattatggaagtctagttaaaaggtaccctaaagaaagggtgggttgggggtgagggataaaggcctacatattgggtacagtgtacactgctcaggtgataggtgcagcaaaatctcagaagtcaccactaaaagaacttactcatgtaaccaaacaccacctgctccttgaaaacctgtggaaataaaaaaagagagaagataccctaaatatactactttttttacaatagttttctgttaattgttatacaaatagaatttcattttaaggaatgtcataatatttagctcaatatttgggatcatttctatcttccctgatataaagaactctggaaagtcattattgaagctccaagctataggtaaacataaacacattctcattttttaaaacagtgttcctgaagtaattcatgttcactgttcaggaaaaaaagtagtgcaaaaatttatgaaatgtaaaaagaagcctcctgtttttccttttttctctctcctccctcaccaattccaattgtaagagaatagcttagtatgtatccttctatatattttctatgcatttgcaaacgtgtatgtatgtttctataaattctttattaacagttttattaacatgacaaatgacatacagctgatattttgcagacctggtgggcatggggagcttggagcccagtgccacccaccctggccctccatggccttaaaaaaaaattatatggggccgggcatggtttctcatgcctataatcccagcattttgggaggccgaggcgggtggatggcctgaggtcaggagttcgagaccagcctgaccagcatagtgaaaccccatctctactgaaaatagaaaaattacctgagcgtggtggcgggtgcctgtaatcccagctactagagagggtgaggcaggagaatcacttgaacctgggagacggaggttacagtgagctgagattgtgtcgttgtactcctgcctgggcaacagagcgagactccatttcaaaaaaaaaaaaattatatacaaatcgttatgcagtgttttcctttatagtatgcgctggacattttttcatttcagtgtacttcaatttgcatcattactctttttttttttttagtactgcatagtattacatattatagatgtttcatgattaatcccttatcgatggacatttggactatttctagtttttcactaccataaacaatatataatgaacatttcttttctttttttttttttttttgagacagtctcactctgttgcccaggctggagtgcagtgtctcgatctccgcccactgcaacctcctcctccttggttcaagcaattcttgtgccccagcctcctgagtagctgggattacaagcgtgcaacaccatgcctgcctaatttttgtatttttagtagagacggggtttcaccatgttggccaggctggtcttgaactctggcctcaagtgatccacccgccttggcctcccaaagtgctgggattacaggcatgagccaccactcccagccttatttatttatttctcttttaatacagaggctgggttctcactatgttgcccaggctagtcttgaactctggccttaagtgatcctcctgacctagcctcccaaagtgctgggattacaggtgtgagccactatgtcaaaacatatgtatatcaaaacatcatgttatataccataaatataatttttgtccattaaaaaattaaactagtttttcacacaactacatgaaatgagaggattttttcattcttgcccttaccaaccttagatatgaatcataaacatttttaaagatcagtaagtgaaatgctaacctggtatttcaaattttgcattaagaggaaagttgagtatctttatctttttgacctaccctatcacaaagatagtttaaatatggttacttataaatgtcatgactatctcacaatatgtcttcagccagaaaatgagactatatataatttagcacagtgtgcaacttatgcttagcattcaataaaatgcttcttatcataaatgaatattcttattttaatcctgatcatttcataccatttatttgctgattagagttgtttttcagtcaatgattttcaaattgcagcacacataggcatcactggataatgctttttattagacgtacttagtttagcgatagtccattaaacgtttttataatacctttgtattatccttgcctggagagttctgttcccagattgtcacctggctgtctctcatcattcaggttttaactcaaatgtcatgtcctccaagaagccttcctatctccattcattttgtatcttcttgccctgttttttctcttgtatggtagagtgtttttttttttttgtatggtagagtgtaagctccatgagagcagaggtcttgtctgttttgttcatgttggagctgcagtgcctagagcaatactaaataatactatgctcaaaaaatatttgtggctgagtgcggtggctcatgcttgtaatcccagcattttgggaggccaaggcagaaggatcccttgagcccagaagtttgagaccagtctgggcaacatagtgagatagtgagaccctgtccctacaaaaaaaattttttttttagttagctgggcatggtggtacacacctatagtctcagctactcaaaaagctaaggtggaaggattgcttgagcatgggagatggaggctgcagtgagccatgattgtgccactgcactccaacctaggcaacaaagcaataccctgtttccaaaaaaaagatatatgtgtatatatatatttgtgagttgtacaagaggctagcaacaagcctttccctggtttaattttgcttcagttattggagacttaagcattgacagttactgtttattctgttttttttttcttaaagtagcatattttaattaacagatgcacatagtaaattaactttctgatgcaacagtcttattataatgcatttcatacttctttctccctaagtagctattaagtttccaagttttctggggaaagctatgaagctctaggctttgtcttgttcaagtaaaaggttaaatttttcattaaggtctgttgattcccatgcgatccttctcaccttgcttaattctgataccaatcttttcttaattttaggcatacagagccaacagtaattatttttaagttactttcaattagttttcagttgtaattttgtcacctttgtttttaatcatgtaggcattggggcatgtcggtctgatctggagaaaaaaaattctctaggatcaaagacaggacagtcacttgatttctctggcatatgagaagtgctgttcctcaagccaaacatttaattgttggaattttatgttggagcaagtaaagatcttaagcttacttcatctgtttaaagagatttaagacaactgccctttttccttgtactcaaaaccagtcttagtgatttgttttactgtggaaaaactggtttgcttaatctaactaaacattttagaatgagtagtaattttgtaaccatcatgccacactcctctttctcataaattcttgtgtaacaaaagtgtgggacagggaatgacaaatgtgactttatttttttaacaaatgtaagttttcagttcttttttttaaatttttaattaacagataataattgtatatgttcgtgggatacagtgtgatgtttcaatacatgtatatgttgtggaatgaaaaaatcagggtaattaacacatctattacctcaaatacttatttctttgtggtgaggacatttaaaatccactctttttgttattttgaaatacacaatacattattatgaattgtagtcaccatgctatgcaatagatcaccagaacttactactcctgtctaaccacaaccttgtaccctttaactggcacctcctttctctatctaacccactccctccagcctctggtactctctacgtgtatgagttcaacttttttagattccatatatcatgtggtgtttgcctttgtatgcctggcttatgcttatttcacttagcataatgtcctctaggttcatccatgttgttgaatatgacataattttctgcttgaggctgagtagtattccattgtgtgtatatgccatatttatttcatctgtttatccattgatgggcatttcaattgtttccatatcttagctattgtgaatgatgcagatgctacagcgtagttcacctttgttttgagagagggagagagagagacagagacagagagagagagagaaaaggcctcactctgttactcaggctggagtgtactgatgcaattatagctcactgcagcctcaaacctatgggcttttgagatcctcccatcgcagcctcttagctacaggtgtgtaccaccatgcctagctactttaaaaaaaattcttttggctgggtgcagtggctcacacctgtaatctcagcacttggggaggctgaggcaggaggatcacctgaggtcgggccaacatggagaaaccctgtctctactaaaagtacaaaattagctgggcgtggtagtgcatgcctgtaatcccagctacttgggaggctaaggtaggagaattgcttgaacccgagagatggaggttgcggtgagccgagatcgtgccattgcactctagcctgggcaacaatagcaaaactccgtctcaaaaaaattttttttgtagagacagggtcttgttacattgttgcccaggctggtcttgaactcctggccttagccaggagttgaattcaaccaactctttggctgaatgtgtagccaatgctacttcacctatttagatagctgtattatggctccaaagctgaaaactgaaaaattaatattaacagccaggcatagggctcatgcctgtaattccagcactttgggaggctgaggcaagaggattgcttagcccaggaggttgaggctgcagtgagccaagattgcaccactgcactctagcctggaccacagagtgagaccccatctcaaaagaaaaaagaaaaagaaaagacaagaaaagaaaaaattaacagcacttagaaaaggaaagctaagtacctccaagcatatctagttttgtaacttatatagttttcctttataatgttaaaacattataatgttataatgtaaagaacttatacattatgaattattatacattattacattatttataatgtaatgtaaagaacttcctttaacatttcttttgtttttgttttgttttgttttgagatggatccttgctctgtcgcccaggctggggtgcagtggtgtgatctcggctcactgcaacctcgacctcctgggttcaagcgattgtcctgcctcaacctcccgagtagctgggattacagacacctgccaccatgcccggctaatttttgtatttttagtagagatggggttttgcagtgttggccaggctggtctcgaactccagacgtcaggtgatccgcctgcctcagcctcccaaagtgctgggattacaggagtgagccactgcgcccggcctcttgaacatttcttatagagaagttctgctggtgagaaattattcatgtttttaatttcacttaaaaatagatttattgaggtataattgacatatatatgtatacataatatatataataagttatacatattaaaactttacagttggatgagttttgatacctaggaacccatcagcacaagcaaggtagagaacgtatctgttatccccaaatgtttccttgtgctaagcagtgcctcactcctgctcttttgtcctcaggctactactaatctgctttctgttactacagattagtttgcattttttagaattttatatggatagaatcatcatatagcatgtactttttggtgggatgtgtgtatcagtagttcattccttcttattgctgagtagtattctatcctgtggatgtactacaattcattaatctgttgaagatcattgggattgtttttggttttggctgttttaaataaaggtgctatgaacagtcatgtacaagtccttccttgtatggaaatatatttccatttttcttgagtcaaacctagaaatagaatagctggatcatgtggtaggtatatatgctgcttttataaaatggaaaaagaagattttgaaaaggagatgagatggggcacttcatcccaggcacatccttgggcagatggtttttagtaaggaattcacaaggaagttgaggatcaggaaattgattccttttaaaaactgtctatgcctgttagtccctgaaaagttttcctgcactccaggggtactgtattccaattagaagatagctgacttagagatgtccccagctacttctcttagttctggcctctgccccagctctgttcttcagacggaccttatgcccaggaaattctggctgccatcttttacacaccaggctgtctggaggcctgggagaaaaaggaattagactggggttcacctgggagaaacccttggcagtggtggagtggggatggattcagaagtgaggtatgatactataatataatgaaaaaatgtatctgctattcatcgctggttcctgacagtgcctaaaacccttgttcaagtaaaaggttaaatttttcattaaggtctgttgattcccatgagatcctgagtaatagaagtgagaagagcatcttttgttatttatgataagcccctgccaaccaaacctgattttatgctaatgaggtggctcttggaggatggcttctggttgccagaggaatcaaccatgtggttatctctaaggtgggacttttcagcctacctcccccttatttctgaggagggcagaggggcctggagatggagttaatcaccagcagccagtggtttaatcagtcttgcttaggtaatgggacccccttaagaactcaaaatgtaggggttcagagagcttcctgctcggtgaacaaatcaaggtcctgggagggtggtacatctggacccggcttggaagctctgtgtccccccgtaccttgtcccattacctcttcatctggctgttcatttgtatcctttataatatcctttataataaagtgtttttgtagcaaattgtttaacatgaggagggggttgtgggtgtaggggccagggaaaagcttccccattgatctccaaaggtttgctgaaaaatcaactcacaagaggcagattaattggagaaaagtcatacagattttattacatgtacacgggggaaccacagagattactcaccccccaatggggttcggaagcatgtataatatcctggcaaaacaggttatatggctggtccaggtgcagtggtgtttacagctaattgatcacagccagttacagatttctttgttccttccactcccactgcttcacttgactagcctaaaaaattaattaattaaataaaacaggttataggagaagggagaagaggaattctgttgtgaggattactaggaagaatgaatggatcagggaagggagattaacttgtacattatcttgtggaaggatctgttcaggtgtgattacattcttggtcttactgggaggggaatgcaaaacagttgttctcggtgggtctggattttaggcgataaaggaacttcagagaacgtcattctgactttgggagaagtcagttgtaggggtgggtggttgggggaagtcagagagaccctgaggtattggttactgagtcccaacatgggaatgcccagtttgtagccaagtcagactaatttgactgatttgtggctaatttgaggatccactacttgcaattagcatctgaagttgggggtagtctgtgggactgagccctaaacctacgggggtctgtgctaactccaggtggtgtcagaatttaattaaattgtaggacgctcgattggtctccacagagaatagatttgcttctggaaaactcacacatctggtgtcggaagcattgtgagtggagaaacagttttttatttatgaggcaagagaggctatgggggtcttgaggcggtattggggaccttagatgctatcatctgctccagtatctgggaaggtctgtcctcctcattggcatcccgtctccagttgccctgtcttcttcctctccctcatagaccactgttcacacgggatacacttatgatccccacactgttttctccttactctcacttctccatccctaggcaatcactgatctgctttctgtcactattccatacatataaatgacaaaatatagtgggtttttttgtttttgaaagacaggatctcactgtgttgctcaggttggcctccaactcctgggctcaagcagtcctcctagctgaaactacagatgcacaccatgactcctggctcaagcacagtgtttttgtactttttaataaatgacattatatatcccatattctgaaatgtctcttttttccctggatgttatgtctttgtttttttttttttttttttttctgacacaaatcctttctttgtcacccaggctggaatgcagtggtgtgatcatggctcactgcagcctacctctcaggctaaagcagtccccctgcctcagcctcccgagtagctggaactacaggagtgctccaccacgcccagctaattttttttcttttttttctttttgagacagagtctcgctcttgtcacccaggctgtagtgctcgctcttgccgcccaggctggagtgcagtggcatgatcttagcccactgcaacctccgcctcccgtgttcaagtgattctcttgcctcagcctcctgagtagctgggattacaggcgcctgccaccatgcccagctaatttttgtacttttagtggaaacagggttttgccatgttggccaggctggtcttgaactcctgacctcaagtgatccgcccgcctcggcctcctaaagtgctgggattagagggctgagccactgggcccagcctaaattttttattttattttttgtagagacagagtcttgctatgttgcccaggctggtctcaaaactcctaagcccaagtgatcctcccgctttgctctcccaaagtgttaggattacaggcatgagccaccatgcccagcagatgtcttgagatctgttaatgtagttagagaactagtgtaccctttaaaaatttttttattgtaattaaatataaataagaaaatttaccagttcgaccactcttaagtgtacagttcagtggtataagcacattcacagtgttgtacaactattaacagtatccttctgtttccagaacttttcaccatcccaatcagaaactgtacccattaaacaataactccctatccctccttttgcagtccctagtaacctgtattaaactttctgtctatgaatttacctatgcttggtcacctttgtttttgtgtttttgaaagatgattgtgattggtaaataactccaggttggaagtttttgtttttttttctcgttcagtaccctgtcttatagcttgcattgtttctgatgcaaaatctgctatcaacttcctttctgtatgtgaagcatctctttggctgcttttaagacttttttgttttgttttgttttggagacagagtctttgcctggagtgcagtggtacagtcatggctcactgcagccttgacctcccaggctcaagcagtcctcccacctcagcctcccaagtaggtgtgcgccaccatgcccagctacttttttagttttttttttaaatagagatgggatcttgctatgttgcccaggctggtcttgaactcttggactcaagcaatcctcccaccttggcctcccaaagtgctgggattacaggcgtgagccactgcagctagccttaaaccactgtttaatccagtgttttaaaattgttttagagggagggttatgtctattcctattacttcatctctcctgatgtgaatgttgaggctggatgcggtggctcacacctgtaatcccagcactttgggaggcagaggcgggcggatcacctgaggtcgggagttcgagaccagcctgaccaacatggagaaatgccgtctctactaaaaatacaaaattagctgggtgtggtggtgcatgcctgcaatcccaactatttgggaggctgaggcagaagaatcacttgaacctgggaggtggaggttgcagtgagccaagatcgtgccattgcactccagcctgggcaacaagagcaaaactctgtctcaaaaaaaaaaaaaaaaaaaaaaaaaaaaaagttgaggatgagcggcttcatgggatggcatgtatttctgtaaccactgacttccacctcccagaaaaaggaagcaacaagccaaaaattcactactgttgttattgggcctgatagtgaaaggatgaccacctaaaaattatggcatccttggaaaatttttgcaaatctgtattttaagcagtgtaaccctttacagtaagggagtacagtgacttttgcaagtggtttagtgttctgactgcatatccagaggcaggatggcagtacgaaggtcctagtgggaacagagagtgagagtctgtgagtctgtggctaactcagacatcagggagaagaatgtgtgatactgtctcagaggttgccaactttggtattaggctgtgttctttgaaatgtggggcactgaatttaggcatatactgaaataactaaataaaacaagagttacatatatgtttcatgttctacatcctgtcaggttatctcatataaataattggattgtgaatatttacctaactttttgaggtctaatgccctaatttgctgctttctttttgtaggtaaagaacaacagcagcaacaaaaacaaaaacagtagatatattgggggggggaaaaaacctgctggttaatatacagatttcattaccttgaagttcactgcactgaacaattctcactctggatgtattcctgctctaggatgtgaatttagacttttgtaatagagtgggctttgagaaatagcttttctgctcattttagtttcatgatgactgcatggaatgttttgcttcacgcttatgcattgagttttatcaagcattaagcagttggccgaaacaggtaatacttgaacattcagtccaagaaaaacaaaatggatttgaacatacgtagaatcagtaactcttattttcatacttccttatggttattcagaagtgttggtctctaggtacattttgaaagcaagtacttgatctggcttaggttttaactaacagcaagcagatactggcctgataaaaagatgatgtacagcaaaagtgagatggtcagaattggcttttttctttttcttttcttttttttttttgagagggagtcttgctttgtcacccaggctgtagtgcagtggcatgatctcagttcactgcaagctccacctcccaggttcatgccattctcctgcctcagcctcctttgtagctgggactacaggtgcccgccgccacgcttggctaatttttttgtattttcagtagagacggggtttcaccatgttatccaggatggtctcgatctcctgacctcgtgatctgcccacctcggtctcccaaagcgctgggattacaggcatgagctaccgcgcccggccagaattggcttttttcattatagactactacagtaaaatcatcctaactgcagaagtcacttgaaatgtggaaatcacagtttgctatgtatttgatttggttcaatctttttttttgctttctgggacatcaaaatcagccagcgagtctagggaaatttggacttaaggttttaatgtttagattttgaaaagccaggatgcttataaaacactcattggtatcatttacgacagagagagagagagaaaggagagagagagagagtgcgtgtgtgcgtttatgtgtgtatgtatatcttgtttaaaaaacagtctggactcagttttctcacctggaacattagaaatgaagtgttagctgggcgtggtggctcacgcctgtaatcccagcacttttggagaccaaggtgagacgattgcttgagcctaggagtttaagaccagcctggtcaacatagggagacgctgtttctacaaaaaaagaaaggaaaaaaagccaggcatggtggcatgagcctgtgggattcagctcccaccttggaaggctgaagtaggaggatggcttgagcctgggaggtcaaggctgcagtgaaccaagatcatgccactgcattccagcttagacaacagagtgagactctgtctcagaaaaaaaaaaaaaaatgataccaactttcatatttgtggcaaaatgagataaatttacgtaactgaaaaagggagtctttttttaatgaattactttatttctttgaggaaaaataaaacagatttgtaaactttgctcctggactagaatgctactttgcaggcaaacttacttttgtaaaaatgctagactctggccagacatggtggctcacacccataatcccagcactttgggaggcctaggccggtggatcacctgaggtcagcagtttgagaccagcctggcctctgtcgctattaaaaaaatacaaaaacaaaaaaattagctggacgtggtggcacacacctgtaatcccagctactagggaggttgaggcaggagaatcacttgaacctgggagctggaggttgcagtgagccgaggtgtcaccaccacactccagcctgggtgacagagtgagacttggtctgaaaaaaaaaaaaagctagactccacattctttaaaaaaaaaaaacaactttgctaagatataattcaccaatgtaaagtgtacaattcattggtttttagtataatcacagagttgtgcagctgttatcaccatcaattatagaacattttcattaccaaccccccccccccaaaaaaaaatctcgtgtctattagcagttgctacttgtttcccccctacccctttctctgcaggccccagacctagacaaccactaatccacgatatgtttctacagatagactgattctagacatttcctatacagtgtcattactaattccttttatgggtggataatattccattgtatggatatacatattttatttatccatttatcaattgatggacaattggctattgtgagtaatgttgctacgaacatttggttacaactttttgtgtgaatatgttttcatttcatatggtaactgtttaaccttgtgaggaactgccagttttccagagtggctacaccatttaccttcctaccagcag

SEQ ID NO: 2 - DNA, 601215 bp, Homo sapiens
ataatcttctctcttggagtgttggtgggtcctgtgaagatgatgggatagtcaccctcttaatcaggttacaataatccacaacctcctcgtaccttactagaaagagattttcttttgctggctttgaagaaggaagttgccttgtggtgagtggcccatatggctaggactaagggcagcctaggagcagagaacgccaccctctagcctatagccagcaggaaatacaagatctcagtcctaaaactacaggcaactaaatcctacaaatacccagtgagcttgaaacactcagtgagaaccctgagccacagaaaagactgtagctctggccaacacctcaatttcagcctgtgagacattgagctgagggcacagtttgaattttcccagactttgactcactgaatgatcagataataaatacatgtagtattaaacaactgaatttgtgctaatttattacctagcaataaaaccctaatatacatttatgtatgtatgtgtatatacatacatatgtgtgtatatatctatatatagacatagatagagatatatacatccagtttcccactggcaaggaattttccaaatggaagactcattatcctctcgctatgatatttctccaatgctttctcatgaaaaagtttcagttaaaaaagatgaccattacttattattaatggtacataggcaatttgaggtgttgatgaaagtcctgcaagttatctaggaaggtgaggccagtggttacaattcatgttattttaaggtgcctgatactgttcagaactcatatttttgaatttaactctccagaatagtgatgaactatgcatgtgttgacaatttgtacttcaactttaacaattccattaaaactctgaagttcagtccactatttttgagggaaatgtgttgagtaagtatcttctgctttaagagaattcacagaacttaaagcggtgttctattccttccagggaagagtttttcctaaaaggcgactccacagggtactaatgagtgctacaggaaaagcatctgttgtcaggaaaaactgagaagtcttgggttaaagaaagttaaatgggtttctccaaatgagtgatcagagctgctcttggagccctttttctcaagagcttcttgcaaatgctgccagggagaatgctatctggaatcaaacaagttctcaaaagatgtgagaatttcattgttgtatgacagattctacaatcgatttactgatttaaaaactgaaaataggggtgcatccctactgttttgaaattgtatagaagttacccttcttctgcccaatgtaaacagaattcaaaagattgaggatggagtcttatgttcataaaatccttagcccattgattctgtattttaatggggaaaattgtctaaaatatccacctcctttaacactgttggtaggtaactgagtttccagtgactacctaagacagaaagagttgattcttcattagggttgatgtcttgaaaacaattttcttctctgagttcactcagaagcgggctaatcagtctaaactgtgatgctctctgctcactcccaagttcattgttctgtgttataagcaggagagcccaccaaggtctgcccaggggttctactcccttcaatccttaacctagttcctccactttctcatctataaaatgggatagaaagaaagtcatccacaatgctaattttgaagtgttaagtgagataatgtgtttatagtgattagcatagagcctgttctatatggcatctttacacggagccctggaagcaaatatcagatgcagaccacaaaagcatcagggattctccaaaatgaccactggagaaatcatcctttcttcctagaaaatgcagatggtcacaataccccataattatcctactaggaatatccacagcagggtgcatttatctaactggtaaaataagtttcaatttaacttgcatccaagtttctaggggtatcattttactccatttgtgctcatccaaaggaaaattatcttctaaatatgattttatcagagtttacatgaagctgtctttttatcagctcatattctgtaaataagtagttaagatttactgctctaaaagatagtagtagaaacatttatttaatctaaagttctcacatcatgaatgatgtatttggaacatgcacagctatggtcaacgtccctgtgacatttcatttcattgtatgcaaatatttggaactcttgggtgttttcttggctctctgtgctgggatttcatcatttaatggatctgggctttggaaaatatgaatgtgttatcagcatcactttcctacaatttaaatcccaaggaactgcattttttgttcttttattggccaatttactatgggaaattaattatgttcctcttaaattcagattttaaatgactttaaaaaataactcaggttatttaattagattcttattactgcatgaatatttcctgccagaacttatggataatgacctaagtaccataatttaaacacgtacatgtttgaaactaaaagtcaatgtagtgttgcctaagtgatactttctatttacaacacagttatgataatcaaaatatcaggttttccattcattcatccattcatccatccatccatccatccatccatccatccatccatccatccatctttcagttatcactgttggaacatctataccatgtgcaagaagctgagattcctcctgagaattctcagacaccaatggtgaaaataaacccatgaagtttaaggaagacatgtggaagtgccatcagcctcacaccaactacttatgaaaggagttaagatgcaagagggacttagtgttacataacactagcacacagtaattgtcactctggccaaccccattaaccacctgattcaggactctctgtctgacagactgacttgtttcatatacaggtgccattgtcttccttgatcatggcactagaattgcaacacatacagcattttagttaccttgagcaatcaattctgcctaaattatccatgccctaaaagtggaatatcattgctaacaaaaggaaaaccttagagaaatcttagcccctttaataaaagttgaaaatcttgatcaaagaaaataaaagacctactagtcaaaaatagtaagttatcaaaatagttggatgcaaatgttattttttaataaagcttaaaatttttgagccctggttttgtaaatactcaagatgtgtgcctcctgttccagcagtcatccaaattaaaagactagagtatgatggtggccttcccagaacatgcagccccaactgagagacaaggttaatttgaaagcccacagcatgagtggggctccttgttctccagtgatgtttctgttggcttccctcctgatatggtttggctgtgtccccacccaaatctcatcttgtagctcccataattcccatgtattgtgggaggaacctgttgggagataattgaatcatgagggcaggtttttcccttgctgttctcatgatagtgaataagtctcatgagataaaatggttttaaaaacaggagtttccctgcatgagccctcttctcttgtctcctgccatgtgagatatgcctttcacattccaccataattgtgaggcctccccagccacgtggaattgtaagtccaataaacctctttcttttgtaaattcccttgtcttgggtatgtctttatcagcagtgtgaaaacaaactaataaagcaaattgatactgtgagtgggatactgctgaaaagataccccaaaatgtagaagtgactttggaactgggtaataggtagaggttggaacagtttggagggctcagaagacaaaaaaatgtgggaaagtttggaacttcctacagacttgttgaatggttttgcccaaaatgctgatagcgatatggacaataaggtccaggctgaggtggtctcaaatggaaatgaagaacttgttgggaactggagcaaaggtgactctcattatattttagcaaagagactggtggcattttccccctgctctggagatctgtgggattttgaagttgagggagatgatttagagtatctggcaggagaaatttctaagtggcaaagcattcaagtggtgacttgggtgctgttaaaagcattccgttttataagggaggcagaacataaaagtttggaaaatttgcagcttgacaatgggatagaaaagaaaatcccattttctgaggagaaatttaagccaactgcaaaaatttgcataagtaacaaggagccaaatgttaatccccaagacaatgggggaagtgtctccagggcaggtcagaggtcttcacggcagcccctctcattacaggcccagaggcctaggaggaaaaagtggttacctgggctgggcccggggtccctgtgctgtgtgcagcctaaggactcggtgtcctgcatcccagccactctagccatggctgaaaggggccaacatagagctcagtctgtggctgcagagggtgcaagccccaagccttggaagcttccacagggtgttgagactgtgattgcacagaagtcaagaactggggtttgggaacctccacctagattttagaggatgtatggaaacacatgaatgtccaggcagaagtttgctgcaggggtggggctctcatggagaacctctgttagggcagttcagaagggaaatgtggggtcagagccccctcacagtgtccctactggggcacaacctagtggaactgtgagaagagggccaccatcctcagacccaagaatggtagatccactgacagcttgcaccatgcacccggaaaagccgcagacactcaatgccagcctatgaaggcagccaggagggaggctgtaccctgcaaagccacagagttggagctgcccaagaccatggaaacccacctcttgcatcagtgtgacctggatgtgagacatggactcaaaggagatcattttggagctttaagatttgactgccttgctggattttggatttgcatagggcctgttgcccctttgttttggccaatttctcccatttggaatggctgtatttatcaaatgtatctaggaagcaactaatttcctttcaattttacaccctcataggcagaagggacttgccttgtctcagatgagactttggactgtggacttttgagttaatgctgaagtgtgttaagattttgggggactgttgggaaggtatgattggttttgaaatgtgaggacatgacatttgggagggaccaggggcagagtgatatggtttggctctgtgtccctacccaaatctcatcttgtagctcccattattcccacgtgttgtgggagggacctggtgtgggtctgggtggacccacatggaggtgggtttttttcctgtgctgttctcatgatagtgataagtctcacaagatctgatggttttaaaaatgggagtttccctgcacgagctctcttctcttgtctgccgccatttgagatgtgcctttcaccttccaccatgattgtgatgcctccctagccacatggaattgtaagtccaataaacctctttcttttgtaaattgaccaatgtacaaaattgggtatgtatttatcaacagtgtgaaaacggactaatatacctaccaaagcctggagcaacattagccaggagcttcccaatctgcaagcagaataaatgtgttttctcacaaaagcaaatattctttctaaatgaagtgatgacatcatgacccaataatccgtttatgaatgctgttgatagatttatttctgagatttatgaccatttctttctgaacttaatttatttcttggggttataattaaatttattattgagaatactattaatgcatttgattttattttcttttttgctacagcctaaacacatttcttaggtcttctttgattgtttttttaacttaagttttagactgtcaggcagcaactctgctgctttctctgtgcccacttctgtggacttctctctacttccatctgtgtgacaatctgaaagatagacgactaagctgatagagaaagtatcaagggaacagccagatacagcacgatgtgaggacatcatctaaatccttgctaccaggtatgggtcagcaatatccctgttgctcacctgctccctaaatcggaccccaatcctggctgccattaccgacatggctgttttcacataactgagcactacattgcaattaaaatagtcaggatgtttaaatcaaatgtataagttgaacttaaacatttctagactttaaaatacttaacatatggcaatgatataaaacagttcatttatcttgaagtttcctataaaataaataattatccaaatcagtgtttaaagactgggtcttcatctgcttaaatatgatttgaaaatcattctgctgtgtgtttctaaaatataaaatggtgattaaataattaaatgggcaaacttcttttaaatttgtatttttagccacagatgtttatttttattatatttatttattttatatttatatttatttttcctaatgcatgctgtacatacattctttagtttctggctgtaaaaatcattctccttatcactataaacacacacacacactttcatatattataatatcataacttataatggaggtcacttatatgccagttcatatataaggttatctaaaccaacaaatgcagttacaaatctgttctagaagttgcctaataaggtgggatgtttcttattcaaagccctctttcaggcctatagaaaatgctccagttgttatacacagaattctgtaccatggataaatgtttttatttatttttctctcctaggaaacattgcaaaatttaagcaagtgtattgactgctttttgcttcaatttctattcacttagacaaataattcaataaggtgtttcataaaaacacctgctctttcaaaatatgaagacagtggccgggcgtggtggctcacgcctataatcccagcaaaagtgcaaaagtggcctctcaaaggggaggccaaggcaggcagatcacgaggtcaaaagatcaagaccattctgcccaacatggtgaaaccccgtctgcactaaaaatgcaaaaattagctgggcatggtggcatgtgcctgtagtcccagcttgggaggctgaggcaggagaatcccttgaacccaggaggcagaggttgcagtgagctgagatcataccactgcactccagcctggcaacagagtgagactccatctcaaaaaaaaaaaaaaaagaaaagaaaagaaagaaagtatttttttaatttcttaattttcctataaatataagtatatagaataagggtaagtgttatgttggggtgaatatagaaatctaagttttctcttatactgtgacagaaaaaaaagttagttttcttttagaatgttcctcaatattagaggttactcagctttattacaccctgaagttttctaatcatattcagatagtacattacaaaatgtcgggaatgagatgcatggttgttcaaacaagaatttacacaggcagacaaaaatgacagcagcagcaggaagcctacatttataatatatatatatatatatatatacacacacacactcatggaattccacaaaattataatccaaataggagtgtggacactctcatataagagattttgaacaggtcatggtgccagtttcaaaggcactgggctaattagtattaattgtatttctgcagtttcttgttaccagcagaataaaagtcaaagtgcttagcttctctgatatttggaaaagtctcatccattgcactgtgttaacccctcccactcccgtggcctgtatactagccacatggcacagtctgatagctcacaaatgctgtgggttcaggcctccatgcttttgccagagctgctgtcattcacgtaagattctgttctcctaaatttacctgaaaacactactccttctttgtgctaccattggatgcaatatccagtgacctgtctgtgcaggggtctccctaacagactgtgagacttgagaagactgtacttatctatttctcattcctttatttttggccaagcactggacacttgctatttatcacacagcaggcacttggcaaggatcaaacctcacagcacttcttctgtaagacatggcgctaatgcgatccatgcaccagaaaacaagcggccatcccttggataatgtttcataacttttgttcaatggtgttcaaaatctttaaaaatactgaataactctttactcaataaacaacttttaaaagataaaaagaggtaaagatcaatctgctagagttcaaatgggtcagaggccaggagtgcatccagttgtgagccccccaccaactccccccataaaggctcagcatggcacctttcaccaaagactgcaatgggtgaatatcgcagtacatttgatgaccagtcattaaccaataacctctgacctttgagatgcaggcaagagggctggaaggaatctttgggataaattatccccactcttgaccttaccacccttatttctttaccttgttgcattgaattggctgtgatctccagtacaatatggtattgaacgctagcagccctggcaggaatcctaggctttttcttgactttaacagaaaggcttctaacctttcatcactaagtatgataatgtttgtggtaagattttaataggtatccttcataaggtgaaagaagctcccattcactctatgaattattcactcacaattcatattaggatgagtgttaaacttatcaaatgtttattctacatctattgaaatgattgtaacattctttctctcttaatcttgttaacataaaatgtattatttacaagattctccacttggtcattataaatatcatattgtgaatatgactatataaatataagtgaaatgtaaatatgtgtgtatacatgtgtaatttatatttaaatcctgatgaatttactctgtacaagattgtacagtctgtacactgcacaaaaggagctgtgtgagagcgtggaaattcagacagaatcacctcttaaaccctgagtcttgaaatagggctctctgtgcccaggtgaagggaccttcagcagggtaaacctgttctacttcacacaaaggcactttcaggatagcaatgcctctggatgccatttatttctaattctcaggcccaactccatttacccagtaaccaagcactggacatattagcttgggtgaacctgctacaaaagtcctcgctttaaaacgaacttccatttccatctgctgatagctctttaacttctaatgcctttgcctactcctaaaggtggccctgaaaaatgccgtgaaagtttaagtaaagaagagaaagataatacaacttaaaatgttgaaagaactcttctctgcatgtctccttacaaatatgatgacggttgggggacttctggtgcaactgtttgatctgtgcagctggcctcaaacctgaaacagacagttctccactaatctgaatgctgccaatgtgtttcacacaatgcctaagaaactactcatggagcagctactttatgccaggcactgagaatgtcctgaggatgcaatgatgaaccaaagagacagggcacctgcaaccggggagtttggaatctcaagcgattttccaagagtctccattcgtccctcatacagaagggcacaggaaagccccggcatcaccaacttcctctcactttgtgttcaccagtgactttaccctaagatagttacgagagcatgatttataatgtaaagctgtgccaagcaaatatctgtcctccactgagatataaatgaaatgtctgcaaagtgccaggcttgtaaaacctcctttggtaataggaggcctgttgtaagtagttatgtagaaagcttatcatttttaccttcagtgcttaggctgggagttaattcagattcctctcaaaccaaggaagcacaagctgagaagctcacagtaaactcacagtcacccctactcagaggcctctgctacacaaacagcagtgctaaagcaacaaatggaagtttcaaattctgttgtgggaaaaggaaccaagtctacttagaaaaacttacaatgtccattgattacttttctttccccacaaaacatgaagtaaaagatagaagccaactgtcagaattttaaaaatcaacgatttgtatcagaatgaaatggtgtttcccttgtccagatttatcttgttatactgtagatgtacccatggggtacatctgagaaaaacagggctctgtagagctgaggatgacaatccagacaaggatagagcagtgtaggtcctgagaagtttgtgtaagatatgtgcacccgaggagaagcctgccaaatctcttcaggaaggcacacacatggaagtacatctccttacaagcactagatttgtggtttacaaaattcagcataaatcacaatgggtcggaattatttctatttcaagtttaagacacaggctaaaagacccatttgttttcatgagatttgcagttcaaaacacaacaaccctactgaagacccacaggccaacctgtattctgtcacataaaccatgagggctcctcagtggacataatgcggcaccctcaggaccataagcaagccactaccacaattctaggaaaacaacagagcctcagccaattccaatgacaacccctcttattgaaacaaacatcttggcatcaccatttgtatgacagtcctgttgagcactgacctcctgaagtctcagtaaccacccaagaaaacccaaatgatggcatgagactttttcagagaagcctggctcatgtacaaggagcttaaagttatgagcttgaatccttccattctttgaacacctgtggcttgctttcaactatgatactttctatcaggcatctgtattattcggtcttgggatctttctgattccagagtgagagctccttaaggtcaagctcagcaagtcaaccagattcatattccacccagctgcatcctgagcgatgcctcatactcatggttgttccaggcttattgtgagacaactaagctgcactagatgactagactggggttgatgtgcatgaggtgcagcatgggaaataagactgtatttgtcgaatgcacagggtgatggccccaaaagggctcaaggccattatgtttacaattttatttacaggaggaagctcaaatattggaattcgcaccattttaaagtatgagattcagatttcttttctaatgaggctctctataatagttgcatgtgctcaatcaattcttgcctgtggggacctgataaggtcctggaagatccctgccaagtattacctaatatcaaaaccaattttaatgactgtacactattactgcaggaacacggagtttcagtgctaacattttaccatttggagcagccctgcaaagctaattagaaagaatttgaaataatttaagaatatgaacaggaaatgagatgttcataagcaaatatcatggaaagaaaagttaaatgtggactaagagtagctccattttagtgtgaagaatctctttgaatgagaacacaaaatgtgttgcattgtaagagatagtaagaatgaacccaagagtagataagaacaatataatacacaagaataatcacttcatttggaaaggtggtgacactcttttcccaaattgccattacctttttaaaaaatcacacatacattaaataactaggttcatttattcactaccctacactctgcaaggtgttgagaaaacaatagtgaaaaaaatattgtccctgattgtaaaatcataaaatgtcattttttagtattagtaagctttgaaacaaattagttcatctaatagtgtagtggaaatttcttctctgaaattgaactaaatccaagtttatataacttattttgaagaaacattaaacttaaaattgagttttttaagattaggagtacttactaaggtaaataaattgtgataaggaaggaagttgtaactaaagttgaagaatgattgtgggaaaggagaatatggctacatacatatatctgaaaccataacattatgtatgtatatacaatcagatagcttccctcttttagatagtaagatcaacatgctttcttccctgtaagaaaaaataatttaaaacatgatgtaacatattttttgaattattaacagagttctactgtgtaaattttaacccaagaaagttggtacaggtctaattatgcaactgtgacagcaagctaaaagaactgaatggccgggcgtggtagctcatgcctataatcccagcactttgggaggctgaggcaggtggctcacgaggtcaggagttcaagaccagcctgacgaatatggtgaaaccccgtctctactaaaaatataaaagttagctgggcctggtggcgcacgcctgtagtcccatctactcgggaggctgaggcaggagaatcggttgagctcgtgaggcggagcttgcagtgaactgagattcagcctgggtgacagagtgagactctgtctcaaaaaaaaacaaaaaaacaaaacaaaaaaaaaccgaatgactgtgcacccccatgcctggtactcaagccctttcaggaatgatgactactcactttccagatctgtcccttgccgcatccctgtacacatcctgtagcccacaagtgactgtgcttccagtgttaggtgtgaatcccatgtccttgggttcacagcctgcacacagagactttcagggaagctcctcctcttaacttggccgagtcctgcccacacctgttggtgcccttgaccctccacacctgttggtgcccttgaccctcacttcctcctcctcatgttccactcagtgttctctcataattgctctgatggcatttattacttcgttattatttagcaatttgaattatgtttttttctcctaagccagaaaggaggctccttgagaaagtttactgtatccatctacatgggttcccttgcaccaattctttacacacagtatgtagtcaacatgttttcattgactaaatacatagatgaaagatctgaaaattctgcaaagtatagtaccacagacatgaatcagtcattgaagtcattgagaattttcttttcttccacatgcaaaattatttcaaatgaacagtatcatgtgagatcacaccaagcattagagaaattaatgatcaaagatgatgcatgtaacaggcagagtttctttcttcctcttcagtttcagacgtcaaggccttattactgaaagctattagcagttgcaagaagataagagaaataaaccaattaaatgagcttcataatgaaaactgcccagcaaatgtcagaggctcctctaaatgtctggattccatctgtctgcctctgccattttgtatctctctcttttgagtttgagaggcttattgttccagagcttctgactttatgtgcggagcccgaataattttataagacagatttcacagtccttctttcagtcactgtcatttttctcacacaatgacattagaggtccttcgaggattgctttctaataatctcaaatagggcaatttcgtgggattaggatagactgaaacagatgtggaaaacactttacatcatgatagaagcaagatgccaaataatagtgtgtgggatgttactttctcatgcagcacggcttataaaatactgtaggaatgtgacatggaatgtgaagagtgttctttgcaactcttccttccacagtagaacctcacgagattctgcaagtcaaatagatcttgaaaaaaaaatatgccatggagggaaatgaagggacaagtgttcagaaatgacagttactgtggcacactatcaggccacagagaaaaccagctatttatttacttatattgacatattttgaaggcttctaaatataaccttgtattcctctttagaaatattaacaaactaacacaaaaacagaaaaccaaacactacatgttctcactcataagtgagagttgaacagtgagaacacatggacatggggaggggaacatcacacactgaggcctgtcggtgggggtctggggctgggaagggatagcattaggaggaacacctaatgtagatgatgggttgatgggtgcagcaaaccaccatggcacgtgtatacctatgtaacaaacctgcacattcagcacatgtaccccagaacttaaagtatcataaaaaaattaaaaataaaaatatagtagccgctgttgtgccctttctcacattcacgtagaagagatctgaactaggctccagttcttaaaaacttttaggattactaaagggatagtgtttgggaagaaagaaacaatggaatctataaaaaatagtcaatgttttgaaataatttttcacactccaacacctgttgtttcttctttaattacaagttgcctcaaaaattattatgtgtgcaagttgttttaacaactgaaatgacacatgctcagtaataccattggaggcactccgatgaaataatttaaaaatggaaactgcaaatcttaagcaaaacacaaattaaaacatattgttgatataattaagcatttctgtcacttctaccaaaggaagcatggtttgccatgaggcaaaccaaacgagtataatgcaatcaaaacatattttgaaagtctctggctgcatttgtataaacatgtgaactgttcctatagcatgcctcattcttgttcattgaacattggtattaagattatattgcgtattgcaaataatgctacagtgaacatgggaaagcaggtgctttacgaggtagtgatttaatttcctttgggtatatgcccagaagacggctagtagggtcctatggtaattctatttttaattttctaaggaatctccacactgttttccatactggctgtaccggcctacatctccaccaacagagtacaatctacattctttacaccctcaccagcacttgttatctcctgtcttttttatagtacctgtcctaacaggtgtactcatgtagcaaatttctgaatacaacacaccatcattaactatagtcctaatgttatacgttaggtctttcaaggtgttcattctacatatttgctactttgtgttatttgacctatatctcctcattccccctgcactctcctgccaacctaacaaccactgttttattttctctctccatatatgagaccttttgttttttatatttcacatctaagtgagataatgcactatttctctttctttgtttggtttattttatttagcataatgtgtgccacatccatccatgctgtgacaaatcacaggatctcatttttaaggctgtataatattccactgtgtgtgtgtgtgtgtgtgtgtgtgtgtgtgtgtgtgtgtcccacagcttctttatccattcatctattgatggacacttaagctgtttccaaatgaaatggcaacctacatgttgggaaaaatatttgcaaagtatacatcagataagggattaatatccaaggtatataaagaactcatacaacatgataaaaaaaatatatatgacccaattaagaaatgtcaagggacttgaaaagaaatttctccaaagacataaaaatagccaaaaggtacatgaaaagctgctcaacatcactggtcatcaggaaaacacaaatcaaaaccactatgagatgtcaccttacgcctgttaggacaggtactctctatgatgaaaaaacagtagacttttcatcatagagaggaaaaacgagtaactatgagagaaggtggatatattaatttgttccactatagtaatcatatgactatatgtaccttttaccatcatgctgtatatcttaaatatacacgataaaatttactttaaaaagaggggggaaaaagcatactgtgaacagtagcatcaacacaccaaaacaatgtaaataaaagacaggtacccagagcattttgatttaagcctcacaagtagtaatactgccccaggtttaagtagagaccacacttcccttatttacactggtatccccagagtccatcacagggtagaagcttattctttattaaataaatggtggaataaaaatgggtaaaaaaccaaaatgctcagattctaggtacagagtgtgagctcaggtaaacctctcttaatactatgatgtatgcagggatttgaacctgaacaaaccaaatgaagaccacgccataagcagcatagtcaattaaggagatgacaatatcttttgagcagatgtatgtctctgaagctttttgttcaattctctacttacttcattttagaaaggtattggaaatgagtctgctgagaggcaatatgctggcctctgcaatatggaacctacaatgggtaatgtctcaggtgatctccaccttttctgtacattgaatgagcagagctaatatcaattagacccacaggtttcagattgggatcctggggtggggagagtgttactctcactcagtcatggcccaagtgccatatggcatggaatgtctcctggaaccatggcccagcctgtacaacaaggtgatggactgaaataggactttaaaaggtagaatgagctatacaaagatgcaaatgaatacaagagcccagccttgatgctacaagttgcacaacacaaaaagggagtacttggctgttggtaagagggacaacatcagtacatcacttaagttggctggatagccaaatctctttttaaaaaataagggctgagtgtggtggctcatggctataatcccagcactttgggaggctgaaacaggtgggtcacttgaggtcgggagtttaagaccagcctggccaacatggtgaaaccccgtctctactaaaaacataaaaattagctgactgtggtatcaagtgcctgtaatccagttactcgggaggctgaggcagaagaatcacttgaacatgggaggcagaggttgcagtgaactgagatcatgccactgcactccaggcaacagagtgagactctgtctcaataaataaataaataaataaataaataaataaataaataaaatgaacaagcaacactactccaggagactactgtcttttaatttcagtagcaagtgctcggtagaatcagaagtagacaaggtgagctacagaaattgaccaaaaacatgtgtccaatttgaagggaacatttaattgactaaaaagcccagtgagtgttctttatggataatcaattgattagctcaaatccgtcagcagcactacaatcaatgacggaagatgcatttggaaaagaatattgtctgattgtttttaaataaacttctattaagactttaaatctagagagtcactcttaattactcatttttaacagttaaaaaatctgacatttaaaaaaccagagacatgggttccatctgactgagcatttgctatgcctttaacagaatctgtttgttctgcatgtactgcctactcgtgtaggcctataaaatattttttaaattgtggccatttagtagaaattattacaattgaaatactattattgtgtctccacatataagttctaggtattttaatatcaagtattgaataatctttatcatggaatttattggaaagttataaaggaaaaatgtgtgtgtgtgtacaatttaagtcacttttacagtaggaaatctcttcatgaaaacttctttcaattaactttgcaatcactgtatttgaattattgtaggcataaaaaatttttaaaaactatagaaatgtacaacagagtcttccaacattataaataaaacatttttgtgaaatattccagatctccataccaattgcaatttccagagattgtagatgattatttatatgtcctagaggcagactcttgatggattaattcctataatccatcatttttcttttctctccatctgtgccatacatcattcttaagcttgattgcgaaactttcagtgccaaattttagaaaacttatacttttgtggccatctgctgtaccactcaattttgtgtactgatattaactttctcaaaaagcttaagcatcctttaacaacatgtggcattttcactttgacaatctttcatatttgcaagctcttcactgagatattttattaaaaaaaagaaaacaaactttgcattccagtgtttgtgaagatataatatccagtttcagcaagggagatcaattattccctttacggaagaatattgggaaatataagtgaatggattttacaaccacaatgcaatggaagagttcaggttgcaaccttcttcataaaggtcaaggtcatgtctttagctttcatggaaatgggtcacttgaaaatcctagatcatctccatcagatacagcaattattaaggagggacatgtctttccccatcagctactgaacggtatttgaagggtagcttccacaaaggggaggggaaatacaaagcagttagaatgattttgactcagactagctgaagccaccagagcttttgatttcacacatcaggctgtgcccaacaaggtggattttggggagatgagccccttggtgtccttagctctgtctccctgctttgctcctgtcctcctcctccctgacctagctactctcaaggctgccagctagtgggcagcagctccagcttcactctcgacactctgtgtgcagagaaagaaagggccttcctgtcctgtatctctctctatggagaagagagaacctttccagaaaaatgacttttctttcatgtgtcccaggcaagaattggtccacacaatggagaagccgtgtgctaaataaatatgcctggcagaaagtggagtgccatctggcctaataatgggtatccatggctatgcgatgactgggaagttctcaccagtccatgggacctgtaaggcaggagggctccagattgtgtttaaccccaattattggactgcagcctcagaaatcctgttcttattggtccattctactatggtcaggatttgttttcacaaagccaggtgtagatgtgcttttggggccgcacagcccctcagcctcctgtggtcccagctgcgggcaaaatggtggtcagttctttgccagacacatccacctggggcacacacttcccttcctgtggctttccatgttgggagtcttctctgaagccccaggagactgctgggttagtgaaagtgcagcctgggtgcatcctcaaccaatggtagctgggaaggtgacacactcccgagaggcatttacaggcttctcagaaaatcagttctgctgcccttagcagtgaccttggtgacaaaccctaataggagcttttccctctttcctgcctcaccctgtcatcctctccacctgctgctgtcgacatataaaaaaccacctgccctaaacccctgtcttgtctcaaaatctactttaaacaggggccaagctatgatgccagaattttcactctcagctcctattcccatgatgaagaaaatagtccaaaataatggttgggatcctacatgtctcggaggctttgaagaacacactgagtttttatgcactcagttcagggctagggtggcagccaggatgtgctgccctttttcagaagtgctactcacatctccataatgtttaatactccctttggaattctgcagtgcacaacctgcacaactgtatgcattgcctttggaggagaaagtgaaaaaaaaggagaaagatgggcatcacttctcagatgcatctagatatctggggctttcccaaggtttcttgcattcttctggaccctcagttacatgcacagtctgaagccaccagggattatctcaataagtgcttaactgttttcggtttttagttagaaccattcactttatcgaatctcatataggtcatatttagctagatacaacaaacttctataagctcattggtgtttaagttaatcttatgaaaactacagtccttaaccttttcaattacttatcaaatattagatgaggccacacagtgtagtgggggaaacaagcaggccaccattataaatgtctggctttgaggctggcaaccttcctacaacctggaccatctcgcttctttgctccaatttctacatctataagttggttacactaacaacaatactacttcattggattattgggaggaattcctcactcattccctaagaagcactttaaacaatacctggcatgtagcaattataatgacagatgatgatgatggtgatgaagaatattatttttatctataaaaattctgtatgttttcagtggagttagagtcaactattttatgtatttcttaaactttattttagaaaatttcctttctaggattataaaatggtattttcatgagcaatggataaacttagttgtatctaatccaggtccaccggcttgttaaagtaagaacagcttccagacacatcaataagtaagccatacaaatagcctactattcatatagggtctgcattagtaccctattcaatagtagcctatatgaatagcttactattcatatagggtctgcatctgtgaggtttcaagggtattattaagggcagcaaataaacttggaaatgggtctacgtccaatgtaaaataacaaccctttaacaaacacaaataattcagtgtgagctgccaatgttcaagtatccacagcttagcatatattggggtgacattgcccaaacataaccaaataaacaaaaataagtgaataagaagaaaacttttcatatatctcttcataacaacccacctgccatctaaggcaggactatgaatctctagaaagccacggttcaaaaatgaggaaacaccaaatatgaatacaaagggaactaacgattacaaacaagcaagcagccaattttaaaacagactgttcaattgtaaaactgtcaatctctctcaggctacctctcctctatattttatgatgaaaggaagtgccagctgtcccatttgaataaaagtacacaccattgcaaggaggttgctatgctcttgaaaatattttagtactaaaaattaaatggggaactagagatacttttttgaagtctaggaagacaggaaatgagtatttctaaaacccacaggaatacattgtccatggaacacgaagatgctgctcacctgataccagccaaataggaaacttacagataaaattgtcccagaaatcaaaattctattagagtcttataaggatatagagtcttacaagagcattcacaaggatgctcagaaaatgttttatgaaatgtatcctgaaaaatatagtatttatatcattaaattatttatacttactaaaacagcattgtcagaagttgaaattaaaacatttcttgaaataaaactacaaaaatcatctacagtatgctttaaatatcaccaaattaagaacaatacaattattaaaatttatacgaaaatatttacaataagcagtggtttgtagaaaaatcctgaacatggattcagaactctaattctgaatcagagcagtaatattaggcagatgaggctatatgcagctcctactttttaaaacttgagtaaaatgtgagcctcaaatagtttttgttgtattagtgaggttgtttaaaattgggcttacacatacatcactggccagaggcaaacacagctgagactgttgagaaatacgactggagctaaacaaatacaaaatatacctgtttggggcttttgaatggtctactttcatgggtatgagatattagatctttcccattaatctcactgttcttgttcgtatacttgctgagggagacacagcaccctggattgtctcaggacctctgagtggaaagacctggaccgggggtcttgctgtctccagttgcagggtttttgggtacctaactggttttctacaggtctcgattttctcatttggaaaatcaggaaaacacgagacgaccttccccaaagcattctgcagaccctaatgtgctacacaaaaatgtgatattttgtaatgcctgtcattattttcatgtgtcacaacctatttaaacttccaatggccacgtttcatttgctctgaagattatccattgtgccattatttgacacaaacaaatgttagtgtgttatatcaactctgactgaccctcgcagaatcccttttgacagcatgtattgattataatgtctttcttcttgacctttccaggctttctgtggtctggttcttttgtatctaggaaataaatatctcccctgtgctccctgttgctctcttaaatcatagcttgtggtcaattgtttcacgctttacatgatatttcagtaagaaatatagtgctgccaaatactaagtctgctgttctttgtaaattatttttgctgtatctgacgctgtctttggctctgatacagcaaaaaataaggtaaatctgctaaacctttgaggaaattttgagttgcattaatttaagaagtaattctatgtatacaacataacattttatatctttcttcctttcatgtgttgtaattttcagccaaaatgtagagttaagatttgtgttacgagtttatcttcgattaattcctatgctcatgatgatctcctaatagtactcttatggttggctgaaatgatcacaatattataaaaatcaagagtgtaaatcaagagaagagctatagaaagacaaaaagctcctccttcttttaagctacacttcaacctaaataggagtaaagtaaggcttatcatttatcacttaacattgggcaaataaattatacaaatggagttgtgtcattaaattctatttgtgcccagaggaccagttctcaaatgctggtccagtcccccactggcaacttgctactgggcaagttcattaatctttctcaggctgattttttttccatctccaagcagaggtaataatgaaaactgccttgcagggatacagagagaataaacataataaattttaattactcttagtgcagtgcatggcatgtagtaggcactcaacaaaagttattttatgatgtaatacaggatttcaggcaatcattaaatattaactccagtatgtgtagttataacttaatttcaatatttaatttgacatcacctagtaagttgggatttgcaagtcttcatccaacaacaattgttacagttactattgtcaaaatagggttaaaaggaaacacacatatgacagtgacaatcatttctattttataaatgtctatgttagacttggcactgggctaggatatatagaaatattaggtactatatgtaatcctctaaacagctctgtcattcaagtgttcatgcttcatatttcatttgaaaacaaccatgtggagaagtagaacagcaggtcaaatctcacagtgactcagaggcagagcccctctgacccaccaccctgctccttccacccgctctgtgaagccacaggcatgcagggctgacatgcagacctggagagcagcaccaaggaccagaggaccccagatgctcctgtgggtttagcctacttggaagtggggagtaaacatctgtgttttaagtgtctcattctgagctcactggagctatgagccaccagggagggacatttgctagaagtggtccctcaatcagctggacacatgtgccccagggtccagagaaggaatgccagggtcacagaatcatcaatttcagggtctggccctgcactttgcagagcaagacagaagcccagagggcagtgaatgcatctcaagttcacagagttaagtgacagcacaagatccaggtcctccctctgtgtctgtcaatcagctccccgaactaatccaaggctctgggtttcccaagcttttgacattgagcaatttacgagtagggattcatggagagaactaatagctcttggcaagggtccttcactgcctctttattgagattcaaataaaggcttggtgacttagtctaagacaaggatgtagaaatttcacaagtgaagctgggaaaatcctttcatgaaatttcagctttaaagtgttggcagaagcagagattcttgagtcttttctaaccgatgcatacttgaacttgaaataatcaattctttctttttcataaactgctataataatcaggaaattgaggtttttatactttccacaaacatattctgtattatataaatgacatttcattagctgactcccatttttaataagctggaactcagagaagcagctgaagcccatggataacaattaaagaaatgagactaggaaggagcactcaaacgtgagacctgccagaccttacggatggcaccctccttgatacaggagctctcagtaggaaaaaccatcaccgccttctccaaggatgacactgagactcagaaatgtcacctcttgttatccagccacacacactggtcacttcatgtctcaaaaatcaatactttttttatacttacagctactatcttgataatagaactcaataaaaaccgaaccctttgtggacaaagatttacgaactgcagctagaatatgaagaccaaaaatgttgctttagctaggtaactatcatttttaaatcaacttcttaggaattcaactgatagtatagatcttccaaacaatccaaagaaaccgagcccttcctttctactgtttgcattcctcaattagtgtgagctggcattcctgccttaggacagacagaaaccaaaatgcatgggagaagacacgtcagaagaaaaatatactcctaccactgagaagtggattgctcctcattgccgcaataacaccttcctagaagtagactaccaaaaggctaagtttggtggtacaaacaaaaagaaaaacaaacctttaaatttcccaaaaagtgacaatagtctctttggagacatatgtgttattctggatttgaaagcagtggttacatttgtttcataaactgtaattctataataaataaagcaataaatacattgatattttagaaagaccttcaatttttacatttatcatcagatggatgtcacacatacacacataggaactacataaaaatgctacattattgcttaatataatttttttattcattaagctatatttgaaggtaattataaaagtcaatgaacaatgagaaaattaatgatgtggactgttctctgaatttttcacactgcaatgtatttagaaactagggtgtgagatcaacccagatcatccattcctgtggtttcccagcaaatgagacaaaccttgacatggcaatgcagacctcagggggcacacatcatgccaccaggaacaaaacatgacattcttcagcaaaatacaaagttatcccatttgaatggttttcctagaacatgtgagtgttcataaatttgtcattttaaaattatttaaaataaatagttttaaatgtcagcatctgaaatatcaataaatatacatcgtaatgaagatttttcatggtctacagttagttcaggctgatctggaaagaagtgtctttataatcagtactagactatatgagagctacgacagtatcttttccattgtgaaggggaagaaatctaattgtaatttccaataacagaaatctccttgggtctggtgtaatatctgacaaagaacctcatatccctcttcctttctgagaatttcccaaggatatctcggctgtgtggtttttgcatgtcacaaaagcaggctttacagcagcacaaaagcattgctcagcctcacaaaccaaaggataaagatgctgcaaaggccaactggaaagatcagtgaggaagcaatttagccagaccttctcgtgctgagcttctccatcaaacctttgccactgtctgtgtccactctgtgcagccagcaccagaggcaggtgagtaaggggaaatgctgttactcttacagaagaagcaggaacagcaaaagcaagtcttttgaaaagagcttgtccaagaggaattttatttgacagtttaaagtgttaaaagaaatataacctgtaaaggcaggagaaaaaaaaaaacatgcattctcttttatcctctctgcattggcaccagcttactctaacaatggctccatatagtttctcagtccccagggtgtgtccggttcatcccacaatgttctataccttggtgtaggcctgatatggggatattattccgtgtcccaaaccgaatagagtagccatatataagcaggctgaaggctttgtgactcagaaatcagaacagaaaaactcctgggacagtttatcccatatgtgaatacttaattcacgaagcctccaggatactctgaatttcaagtattttctccagatattctaattaaattgaaaaacttgcatgatttgcagcatctagtgtgtgtagagaatcgagtacttgaccatgttgtgtttacagagcactcagtggttgcagaacatctagtgtctgccaagaatctcatgtttgcagaagatccagtgtgtgagaggacctggtacctccagagcatctattgtatggggaacatccagtgtctggacatgtcatatttatagagcatttagtatctggagagcataaggtgtttgcagagcttctagaatgtacagagcacctagtgtgtgagaccatttagtgtttgcagtgtaccaaatttgtgcagagcctctagtgtgtgcagaacatttattgtttgcagaacatctagtgtgtgcagagaattttgtgtgtattgagtctgtattcctggttctggattgtgggctgggtgtgagaagaaggctactcaccacattgcagcctgcacagtcaggcccattctcacagatcctgcggcgagcttgaatgccacccccgcattgggctgtgcaccgttcccaaggaccccagcctgtccagaacatgtgtgggggacatagcaaatgttcattgcagtatctgtaatgaggaaaccaaaatgacaaggaaactaattagtgccacttgaaaccactgacgtttccatctccatccctgcaccagatgttgaacacatgggcatgctctgcgtggaggagctttttgtattttgagcagttgcaccatacagaaggcagatgtggtgctggccatgctgtgtgtgcacagacaatgggatgcatggcagacaatgaagaaaatgctaaactcacaatgcaggatggatcttcctgtgcagccaattaaaggaaaaacaaacaaaacccttcaaacagacacccaaaaataagagtatacagaaaatatctaggtagggcatttatcttgtgaacataaacattgaaagataaagcagattacagatacaaagtcagcatagctttacttggaattcctttctcattcttgaatcaaataagcccatagttatattaggataagttaaagaaaagttagagcatgggattagcatgaaggcccaagttatatactgcttaagctattctacttttaaatttatttgtaggctctcagaagaatgccaaacaatttaaaagaccactcgttattcaaaaagaattgattatacaattttacaaatattagttctatttttcagtgtttgaatatacttctatacttctacatatttttccaaatgtcagccaaatatccaaagcctcctttatccttatcatgagtcatattatttctcttcaattttttttttttttttttttttttttttttgagacggagtctcgctctgtcgcccaggctggagtgcagtggcgtgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcaatctcctgacctcgtgatccgcccgcctcggcctcccaaagtgctgggattacaggcgtgagccaccgcgcccagccttctcttcaatttttaacactgcaagtgaaatgaagtgaagtgaggaaagtaaacaaacaaaaaacaaaaaggaaacagcctggcattctacaggttacagctcatagaaaggaagaggttagtctgaacagcaccaaatgtagtgagacacactcggtgattcatagtccatctaagaagcccaaattcccaaatttaccttctagagaatactagaatgcacaactttttctcatgccctcctctcttgctaggctatctgccttaagaaacaagaggcaaaggttcccatctgctggtgtaagtcagtcacctttattgtcatcaatattaataaaggcttaatcctgcagggcctatgcaacaggaattgcagaaggcttcctgatcacaggtattcacagtcgaaaataaacacagggacatggacacagctcaggatgtgcaaaactatcttaatacacagtggcattactgtaattatttatgcagaagtaaatgcttttctggaactgaaaataggggcaaatggtagccagccaccaggaaaagaaacttggagagtgtagtttcctgacagtgaatgctggtaagatggaactgttttcctgtcaaaccagaaaaatttcatggggaatgtgtgggcttcaggaacagggacaatgtgaaaagtagaaagcaaggccaagctgaggggtgctgacgggatgaggcacactgaacccctgtcagcattttggaaaataatggaaggtagaaatggaaagagtaaagcacgaaagatcattgagaagaacaaaacataaaaaggcaacagggagtgggatgatctatctttaccaaatacagtggaaaactggaactttatgagaaatcaggaaacttccacagagctccagagacaaaataactccatgagagttagatggcagactcatctccaggagttggtgcttcatcttgactattctctggagcccctgagattcgaggagctcctcatatttcagtatggggtctgcatctccccagacagggcagtttagcagcaggaagagcccatagaacaaacagcaactagaggacgctggattgcaacaattcaaatgagagatactccaacctagaaaacggcgatggtgttggaaagaaggagaagaagtggtggagatggagcttggtatagtgaaagtacaatatggcaactgtgtgactgtatagaaaacaaaacaaaaacagtggagtccaaagtcagcctcttaactgaaagtggaaggcagaagacactcttacttccagggagagatagttgatgtgtagggggtgaaggagcctccggagagtcaagaaccaactgggcaagcagtttagtttgtctaaacttacacatttgagcgtagccaatggaactgaacagttatcactcttcctcatcttttccacatttaagataacacagaaacgtaaggttttcctctttaggtggtaactatagtctcccagggtcctattctcagagctcagggccactggacattcctacacgtagtaggggaagggaaaggaccttctaattaagagatcatggcctctagataggagagacaagacaaatttgagaatacaacagatgaaaagaatttgatcttaggaagtacgtgcaaatgtgtcgagttccaataagtaaaattaatatgtgtgttggttcatggagtattccaggagaaaattgacacttgttttgagaacatattttgaggaagtcaagaaaactcagaatatcagaactctcagcatttagttaaaatatctatgtgtagctcactgtgggtagaaggagaagtaggctatctccatttctaagctgattcaccagcatttaaaaggcatggacttgttagaaaacttgatcctaatttcagctttcaacaacccctctcctaaaaacaacaacaaaaaaatgggtatggaaggcagagggaaaccttaccaaaaatgtttataaaacccctgacttttaataaaaagcacagcaactgagctaccatttccccaaagcaaaataaaccatagcacacaaatcctttctgttatttgctgacagcaggccactcctgaaaatgctcagcatgttattattgtaaaaatctaccgcagggtaacccgtgcatggaactttcagccagtgttaataaattgtctactgagctgcattttaaggttgtcaataacctgccttgtttttttctctttctcctatagtagtccatgaaacaagccacaccaggatctgctggcgtgtcaccctctgaaattgcagcctccccattgagagaggtcagagggaaatagaaattactaggctaactctgtctctttgtgtctgggttttcacttaggaattcaccctggaagagactgttcagagacaaagtgcttggaagcctgtaagtatggatcctacacaattgtgagaaagtgttttcctctgaccctctccctgcccccagcccaactaactcatgcccctgagagaagcccctcttatgaagctatacaaaaaacaatgaggttggaagtcagttactttggtatctgctggttaagggttttaaaattaattgtggataaaatatctacacaatgggccagcagttggtcccctttctctagtccccaacacactgcagacttttagcaaagaatgagctacaatgtttttcaaatgctattggctcttgagtgtctctactgtgttaaagcattgcaagtcacagatgtacctcatgatgtgttaataattaagattttaattttgcccatgactgcttattctcattttgtatttaaaagtcaattaatgacctagcactgtttctctataaattatccactttttttcacaaatctagtctcttatgaaaataaagaccttttataattccatatggactagattctcagcactatatcatgcaataaagtgttctttctattataaattataaaatgcataaattatgttccattctggttagatccatgctagttgctcactgcaatctctgttaacctgaaccaatcagggcctcttctgaactattttcttcttgcttcactctaaatgatcagccctctactgggccatactgctataaatttttatggcaacagggaaactgcacgtacattaagtctaccataatatttaattcaagccatttaggaagaaaaataacttgtgaagaacatcagtttggctcaccacaggattcagcaaacatactgatgaagacaaataatcacttaataaaaaccattgagccctgggactcttaactttgagaatgcattggacaggctctaacatgttccccgtgatccccagctcctagaattcacaccttgcgtaatctcctcctattgaatatgaatgggacctgtcactggcttctaaccaacagaatatgtgaaagattttggaatgtcacttctgtcattatgttacatagattgtaataccctaatttcaagagaactttctcccttgttggctttgaggaagcaagcaaaaaggtgagaaggacccagttgtcaaggaattgagggcagcctctggctaacagccagcaagaaactgaggccctcagtctgacatcccacaaggaaatgaaggctgccaacaaccacatgatcttggaggcaggtctttctctagctgagccctgatgacatcacagctagggcctctatgttgatttcagccttgtgagaacctgaagctgtgcccagattaaaaaactcatagacaccatgagcaaataaacacctggtgctttaaatgcctaaatctgtggtaatgttattatataacaactattaacagaccgtggtacatgggagtgcagtgctactgtaagaggttggaatgtgaaagtggctttgagaccacggaatggcaggaagcagaataattttgaggagcacattaaagaaaatctaaatcaccttgaaccatccattagtagaaatctggacttaaaggacatggccagtaagggtttagaggaaaatgggataaagaactaaaactgaacatcaaaacagatggtcttcccaccacacacacaaaaaagaaaaatttgtgacgtgatgcatgtgccaattggttcaatttagccatccacaatgtatgcatattttaaacaacattttgtacatgataaatatttacaaatttcatcaaaaataaattagttattgaaaaagacaaaaacacaattagaaaaacaggcaaaatatttgaatagacatttctataaataagatacactaatgtccactaagcacatgagaagatgctcaacaatattagtcactaaggaaattcaaatcaaaaccacaatgagataccagttcatacctactaggatggataaaattaaggaaaaacaaaagtaaataagaagaatgcagagaaattggaactctcatgcgttgctgttgggaaagaacattggtgaagtctctttagaaagcagcatggtgtttcctcaaaaagataaacatagaattaacatccaatgcagcaatttcactcctagatatacagtatacacaaaaaagttaaaacagggacttaaatggatactcatatgccaatattcagtacagcattgacaatagtcaaaatattgaaaatataccaagtgtccactgatgaaaataatggataaacaaaatgtggtatagccatacaactgaatcttattcagccttacaaaaggaatgaagttctgacacatgctacaacatggaagaaccttgaacattatgctaagtgaaacaagccagacacaaaatggcaactactgtaggattccacttatgtgacatatctataataggcaaattagtagagacagaacataaattagaggttatcaggggttgggaggagggtggaataaggaatagttattattgcttaacaattacagagtttatgtttggggcaatgaaaagttttggaaatagtagttacggttatacaataatgtgaatgtcaataatgtcactgaattacacacttataaatgattaagtggcaaatttatgttttttttgtgtgtgtgtgtgtaaaagcacagtaaaaacttaaaaagtaaacaggaatatattatcaggaactggaaaaagggagaactgcattacacaatgggtgaaaactgccaaaactgctacctttgttaatatgaaaggcaaaacacataagttgaattacatagctaaggaaatttccaaacaaagtgttgaaggtgctgcttggtctcttcatgctgcttacagtgaaatgtaggtgaagaaagactgaggaatggattattaaactaaaagaacaggaactggatgattttggaaatcagtcacttttaatggcaaaagatgcaaaaaatatgaaatagctttcacagtcctttcaagtactgttagggaaggttggaatacagtaaaagctgatgtagtgactgtaaaaccttttattgtaacctcagaaagatgaaagaattggagtagtatttagttacacaaagagtcctttctagagcaagtgtgtgcctcacagatcctctcaactgcatcagatcacctctagtgagctggagggtgttgtctctcagccatctcagcagcaccccaaggtagagaagagctaactcaaaaaggtctgtgaatgtagcttttgtttagtggagtaaccttgtagaaatccattgaaggcccataatgtttttaagaaacttatttccacaatgataccagcagcttggatggaaagggacagagaaaatacacatgaaaggctgctggaaaccctgcacattctactgacaggaaggaagctgataaaactacctagctacaagcacgtgctctcttcaagaaaaagaaagcctgactcaggaagcataactaagagtccagaaggcagagccaagaaccataaaacattatgcccactccctgaacttaattaagcaactccaaacacttgctcagctagatttcagaatttatatggaacagtgattccttcataatttccatcactccacccacctactgcctttttgaacagaaatgtctaaagctgttatcctttgcctgactctccaagtttgttagtggcagataacttctccctttggctttagagattaacagactgatgggaactacacccagacagcctcttccacatgtgggcctgatgtaaataataaggttctggactttggggagatggcttaatgggataagactgagggaccttgaaagtgggtgaaatgcattcagcatgtgaggggtagggatgtgaatgactggggaacagagaatcaactctggcagatagactctatggtggccctagtgagctctgcctcctgatattcataccctgtgtcatcacctcctctaggttgtggaggcctgtgtcttacttccaaacaacagaatatggcaaaggggtgagatgtcacttttgtgattatgttacataagtttgtaatgcccatcttgcaaggagactgtctttcctgctggattttaaaaggcaagtgacaacaccaggaaggatcgcttggcaagaaactgagagtggtctctaaataacaactatgtaaggaattgaggtctgcagtttgacagcccacaaagaactgaatacaaacaactaccacatgatcttggaagtgcatccttccccagtggagcctcagatgagaccacagttctggcccatgttttgattgaagcctgctgaggccccaagcagaggatctagctaagccatataggaattcctgacccactgggactatgaaatttcaaaaagaaacgtgtgttgttttgagccacaaagtttatggaactaccactacacagcaggaggaaactagcacagataataacatttgcatcttgataatatttgcagacgtccatttcttccttttgttagtagcctctctgggagttggtgcttctactcagttcctgctactccagaaaatcttttcaaggaaatgtcagaagagaaaaagaaactgtctatacattttaaagtacatgtaaaaattaagctagagttatttttcagaaaaaaaaattatgtaaatacttctgagatttttgttgcaacaaagctcccattgaataattccacacactggagatgtcccagatgaaaaatcactaactataaacctaccattaacttagggaatcttttgggaagatcaattcattatcttgtggctacccaggatttcttgagggttgatggtgtttaaataaatatgatatacatgtatcaattattttgtatgcctagttcttagtcttttgtattctcccatggagatcatagtctccttcaatcttgagcttagtcctcaaacatctgcattgttggaatcagaatgcttttatatttcttaggtgaagagacctttcatataacatggcagagacatctaagaacctattgcttatgaagaccacagaggaaactttaggtacttggtttttctggttttcattaatctcccagtagccccctagaaagactattcaatagaaaagcttaaattctataaaaattttacatagtccctgttcttactatccatctattatttaatttcacgttttcctccattgagcaaatgctaatctacaaatgaacatttcttctttacaaaaggaatattttacatataagtccctcaaacacacttgtcatctttattgaagacaccgctgtatcttttcctgaagacaccgctgtatgaaaaatcctatgtggatgcaaacgtacgcatatgttagccacagtgttaatcagcctcttccttcctgtgtgatcagcctgggaatggtgataacacatgctaagtttgtggtggtgccttgactctagggaagcctttgtacagatggaagtgactttgcctggatgggctatacaggttgagcatcccttagctgaaatgttcaggaccattagtgttttggatttcacattgtttcagattttggaatattggtgtatatataatgagatatcttggggataggacccaagtctaaatacaaaattcattcattcacacatcaaatataccatatacacaaaggctggatgtagttttatatattttaaataattttttgcataaaacaaagttttgactgcattttgacggcaaaagtcaaaaaaccgtgtggaaatttccacttgtggcatcatgtcactgctagaaaagttttggattttgaagcatattgggtttcagattttcagattaggaatgttcaacctgtcctaggtgacaattcatagcatttaaaaacttccaaccaatttaaaattgtacaaggcttggaaataatagggagacaattcttccataataggctttcccacttatcaactggtgttagaaaatgacagggcttgcacaagactgtctcagggactgcttaaaaaatgacacaccctgcttggtaaaaatcatcttcatttcctgttagtcaaaaggagtgaaatcttaattggcaagtgaggaacacacttgaagaaaaaaaggaatgattctccttagttgattttaggttgtagtaaatacctaatagagagctatctaaacagtaagtctgttggttctgttcgtataaatactaaatgcatagcaaataactatatacagtatttttattcgaggttccagtgagctcatgtcatcaaatataaacctgctacattttaattaaaatgcactgaaagtcattcaataagtttatattagtatagctgaataagaatcctgaaagcattatgaaatttacctacttgaattctttcccaatagtgacaaattagaataaacattaatagtatatttaatgcatattaagacagattcaatgatcttgcaaaacagattcaatgattacgattgcagaggttgagcctgaaaccaaatgtctaattctacaccaagaaacaaattgttaaatccaagactaaatcaaaatgttgccatgatgtgctgaaagctcaaaatacacgtggaaaagagcccccaatttgggttgtgctgcagcttcattgagggtatttctgaatatgccctcccatgccttccagaggattaactgagttctgaggaaaaccctaccgcacctgcccagtagtgtctgcatccgggaccttcttaggtcctccttggaactggagctttgagatctgtctggttaaattctcacaagagtaagtctcctgcagacgtacttccagagtctccaggagcctagcacagcacagaggttcctgggtactctaatcccttggcaattgctcagcggagccagcccagctgtgtaggcaccagagcagcccagtgatgctgtcgacgaggctttgatcaaaattaaaggatgccaggaaaagaagaggacgactggctcagcggaaagggatgccacacataagcttaggcagatccaaaactaaaaccgcggggaactcgacctggccggaatgagagtaagcgtgaggctggcggtgctggcagcagggtgggcacgtacctttcctcgcggttctgtcccacgcacacccggcccccgtgcctgggagtggggttgctgcaggagcgctgccgcacctggaagccgatcccacaggtagtgctgcagggagaccacgaggtccagggagtccagcctccgttcctgagggaagggaagcaatgcaatcattaggtcccgcaggctcagagtccaagccctgtctgcacccacggccaaatgcctgtgttcctcaggaggatcacgcttggggctgctcaggagagaaaacaccagccaggggactgaatggactgcaccctgtgaatctcaattcctgtgtctgcagcccccaggcatctggtttatagccaagataggaaatttgagaataaagttttaagtgcaccataaataatggactatattagaaactatcaaaaaacttgagtcatgaaaatattaaactaataaagaataaggttatttcactgaaaagcatttagaaatgaatccctacacctctacagtttaggattttttggacttgtattatatcatttataatctatgagaagtgcacctttggacaaaatgctcatctaaaactgccgaaaatgctatcttttaaaatctattaatatcaatgaaaatcagtaactttcctgatagcatcaaattgataaagagtgttgtactgttagaataactatcaaagctttaaaacgaaaatgttgtattgttagaataatattcaaagctttaaaacaaactttattaaaaatttaaaaaggatgtttaaattcagattattggctatcttttcacagattgacagagacataaagagtgcaaataagaagtgcaaattgcatataactaaccatgtgtatttatgttattacacatacagagtaatgtagatatataaaaatataaaataaaaataggatgaaccaatttaaaaaatttttttaattctattgacagctctagaaatgttttagtattgtattttttccttaaaatgcttgtattcagactggttataatttaagtgtcccccttaacacgttgctcctgctattaaaaaatacataggtttttttttaaaattttatgtgttaaaatatatattaaatccagattccaaacttccacatagacggtctacttcatgcagaatttttttacttctgcaatcacatatgcatttctttggatatttgtcaccttcatccataagatttacatttcctatgaaaaaatattagctcacattaattctcatttttacttcgtgtatttccttttaaaacatggaggtcaacaactatgccactgaaggtcctgctataaataatatgttgaatatatcatattaaaaataatttcaaataaaaatttttctgagaaaattcttagaatatttcatgttttcctactttactgaaacctaatgatttaataaaatatgtagtaatagctttatgtatgatattataataaacctgctctataataatataaccaaaattatcacacaataagacaaatcttcccacatttcttataaagataatcagctagtatcttataccctgctacctaaaatcttaaaaattatccatgttattcactgaattatatttaaaaatttaaatagcagttttaatataaataaattacatttaatttgcaaagtttcattacatgtgcaaaaagttgttagatcatgaagcaaatggtgctttcaaatttgtttggaaactcttcattttttaaatcttttagcaaatgtggattgatttttttttttttgagacagagtctcgctctgtcgccaggctggagtgtagtggctctaactcggctcactgtaacctccgcctgctgggttcaagagattctcctgcctcagcctcccgagtagctgggattacaggcatgtgccaccatgcccagcgaattttgtatttttagtagagacgggttttctccatgttggtcaggctggttttgaactcccgacctcaggtgatctgcccacctcagcctcccaaagagttgagattacaggcgtgagcgaccatgccaggccacaaatgtggaattttatgacatattccatttacaatatatggaacatgtttgtatatagggtagtaactaaataaaagtgtatataagtaataggaaaagaatatctgaggaaagaagtgaatgcagctttacacgtatatgtctattacccagacctgagtttccatacttctaaatgctgcttagaggcagacacagtgaccaaacaagtcacataaagtaaacagagatcaggagggggtcactttcacgattattagtacaaagcaatccacttacgtttttaaagcctcattaaaactagttcactttctagatttttaatcttaaaataactactagttgcattgcagctctgcttagaaaatgactttccaactagagcaagaactgaagacagatcgataaataagttatagcaattcatttgataatcttctttttccatgaaacaatatgagcaaagagtattagctacttgttgtaatcttcaaacaacagcagtttgatagtttttgtaagttttacccaggcatctgtggaaatcatttcatttaatagaaagcatacagtacataatgcaatgttgatatgcctgtgtcccctgtaatacaaaacaaaacaaaaaaaaaccctaatctctgtggccctgatttgctcctttcaccttggtggtgagaaaaatgtgagcagagggcaaagtcggccttttgctcctgcactttactttcctggcccacttcctcttaggtgcatgtgcctgcatgacctgggctctcctacaatttgatcacccaatctgatttccactgttagtgacttcataaacaattgtcccagagactttttttttcattctaagtgggctcatggaaagcagataatatgtttaaaaaatactgcaaattaatgaacaagtgacaaagaagcataaagactgatctcagaagtgttcctgatacttgctttaaaatttctctgtgatcatggtgttataggtgcaggggatggagagcaaacagaatatagttgtaaaaaaaataaataaataaaacaaacaccaccacagtaagcggaagcaacaggaaagctattcaataggttatcttatttaaactgctctcttgattacccagtgcctaacgttagctcaggtgaggtgctctgagctccaatatcctatggagtagagcaagtcgatcaaggacttggcttcttctacctcctaacctagtgttattatatcctacccctaatggactatttgtagatatattccatgaaaagactattaaataacatggatgttttccttaaacaaagccaatcatattgtccaaattgtaaatacttttcctaatctaatgaagagtatgtgaataagcgtagatctgtaatccaatttatagtttaaaatctccttgcaaaaatcatgtaagttttaaatggtgaatgtccctggtgtttcaccacagttctctccaaaagggagttatattataaatgatgtcccaaactcctcgagaatctgagtttaatacacagcagcacaactggcgtgttctgagcggcacacctggaacagttggcgatctccatgccagggccctcgcactgccagccaccacactgcggggccgggctgtcgcaggagcgggttcgacagaggcaggatcccacggcgctgccatctgtgtgcgtgcaaggcgtccacggagaccacacaccaaagtgcccatccacggtgagattcctggtctaggaagcaaaaccaagcagaggtgtcagaaaaggttaaagctgaacacataatggagtaaaaattaaaaatccctcataagacaatcaaaactcctctagaatttgttgttgttgttgctgcagttagaaaaagggccaggcgcggtggttcacgcctgcatcccagcacttcaggaggccgagacgggcagatcacgaggtcagaagatcgagaccatcctggctaacacggtgaaaccccgtctccactaaaaatacaaaaaattagcctggcatggtggcgggtgcctgtagtcccagctactcaggaggctgaggcaggagaatggtgtggtgtgaacccgggaggtggagcttgcagtgagccgagatcgcaccactgcactccagcctgagggaaggagcgagactccgcctcaaaaaaaaaaaaaaaaaaaaaaaaaaaaaaaaaaaagattgcataagggagtatttcaacgtaaagcagcagaggtgattgctggagatggtgaggaagaagcagggagggagacagggggaaaggggagacagaaaataagaagaggaagatgaagaagaagaaggaaaaggaggagggggaggaggaggaaaggaaggagaagaaaaaggagaaggagaagaatgatgggaggagggctgagaagagaggaggaggaagagtgaaggatactagtgacttggcatcaagttatggacaaattgtccactaatttggaaaatccaaaactaagaggaactggagtgaaaaatcacagctgcacaaccccattgcatgtttatgtgcctttaaaaaatgaaagcttagtaacatttatcattaaagacttggtttggctctcaaactgaaagcattcaattcagaacatatttaaagagtatctattaagcagctgcagcgcttctctttgttaagaatatcccagtcaaacctgttttctgatcaacttctaagagcttacgggccagtgagaaacagctagacacataactattactccatgtagaatccgacgatggattcacgaacaggggctatcggagcagaggagagaacacccaacatgctcacaaggtctgggaagagcaacgaggagcctgtgttgagtcttaaaaagtgaagaaagagccaagtagaggggctagcaagggctggcaaggatgaaggcagaggaatgaggctgccaaatgcaaagggcacatgggcattccccatcagtgtggggtgagctggtggttcaggggagcaacaccaaggactgaggaggaacccagggcagggaccttatggggaggggtcagggagccccctgagcttgctggtgtggcacctctgaaggcactcaaggggagggcatggcatcgctgggacatgcatgaccagctctggtgtggcggaggcaccagcatgtacctggctcattgaagaagggacggcttcttgccaaatctgataagcaaatctgctcaggaggtggcagtgctgctggaaggagagactcatggggcacagccttacatcacatgcccagaaaccagcaaacagagctctcctcagaaaggcaatgggaagaaggcctaagtctaagcctcctgttttggttgttgttgtttttgagatggagtctcgctctgttgcccaggctggagtgcagtggtgtgatcttggctcactgcaacctccacctcccaggttcaaacgattctcatgcctcagcctcctgagtagctgggactacaggcacctgtgaccacaccagctaatttttatatttttagtagagacagggtttcaccatgttggccaggctggtctcgaactactgacctcaaatgatcagctctccttggcctctcaaagtgctgggattacaggcatgagccaccatgcacggcctccaaacctcctaatattaatatggaaacttcagcatccttgagaaaatctgagcaaggaagacctttggtgatgagtgaaccgcatgctttcaccttgccctctgcagctggctgcacccctcctcctctgccagagttctcttccagaaccatccactaccatcggaaagactcatcatcctcacatgaaacaactcacaggaaacaactctatgtaccatacagttcattctcttcgggttacaaactatacccatacttcgccatttcagaataatgctgacaccatattttgtgggtaaaaatataggcaaactttacttttgatacatcattgacccaaatacaataggaactaacatgaaaagtgttcgttgtttttgacatgaccggttggccaaatccaattgctataattatgactatccctcctttctaaccaaccctctaacattttctatccagtaaggtggatgggattgggaatttccttccatacctggctatctatgtaagaaactgtggcaaaacggacggaatggagctgcaccatctgttagagcaattcttttctttttgtaaattttactttaagttctgggacatatgtgcaaaataatcaagtttgttacataggtatacatgtgccatggtggtttgctgcatctatcaacccattacctaggttttaaactccacatgcattaggtatttgtcctaatgctctccctccccctcacaacccaccctccaacaggtcccaatgtgtgatgttgccctccctgtgcccatgtgttctcattgttcaactcccatttatgagtgagaacatgcagcacttggttttctgttagagcaattctaagtgatacactggatcctacccaagaggaaaatatccccatttccaaggtctcggtggcctccctattggctaagatgaaaagacagtgcctactctgatcatgaggttctctgaagaccgtagagctttcttggagaaccaagccttgcatgacaacgtgactcaagccactaatacagaagattctgtgttaaagaggcaaagaccctaccatttgggattttcaacattctcctttcacctgtttatcagccctccctcttgtctccagccaaaagactcctgtgtcagtggataagaggtcactttcactgtgagcaaacgtagttcctatgcttacacatcctcgcctgctttcacatccagactcctgcttgctgtgcaaaccttgctagtattgttttgactgtcaaaagcatgtctcttgttcatggagccagcctcaagcaataacggtggtcagacagaatatttgcatcatagttacacaatatataggtctgtactattttgactctttgcagtgtgggcccagttaagaaaccttctagggctgctgaaggccccagcagacaccaccatgggagctgtgaccatcctaagcctgcaggtgggagggaggacagggtggctggagcaatccttagttgaagggggtaagggagtgatacccgtcttattcctcctgcccatgcctctcattacctgagcccaaggtcacaagacagcaagggaaagaggatcggacattggatgtgaggaaggtcagacccttgaggcagagagttagtggggagggagactgtttgagaggctctctgggacatctgttcatccttagcctcacttctctatgaaggtgtaacagctccaagagttcatcttgccctccactcagaaagccaaatgcactgggaacaacaggaatgacagcaaaaaaaaaaaaagagctgaattattacagggccaggcaagtgaggagaacagaaagaaattcctcaagcctgactccctgagaattcagaggctaggggtttttgagggtactttggcaggccggggtggggaactgaaacagttgatgaaatcacagcagtgttcaaactgccttcaggcagctgagtcagttcctgagagggggtctcggactacaggacagcttttggtcagctgaagtgctaaatctgaaaaatatctcaaagaccacttctttaggtttcacaattgcaatgttatctataggggtgagttagagaagttataaatcttgtgacccctggttacctgaatctgtggtaaccagcttaaagaaaagcaggttaaatgtcagcaggtcattgctcatgcctattcttcagcaaaggtcaagcccttaccattgtgaatacagtttcaatctctgaatacgaggacagggaggtaagttttccttgcctcaaaatttaaccataaactaaattcctctcacagttatcttggcattggtctctgtgttattatatgtaaaacaaaattacataaaacaggttagcctgcgacgttaaaagcaaggtggaatcagtcatgctggaattctctcatcacttctaattctgcaaaggctgttccagaggtgtgaggggtcattcaggttgggatgctatggaggtcaaagcagttctatcctggatgctaatccaccatgctgacttctgattaacccaagttctgggaatgcctctaagatttccagtttacctattgttccttgtgtaagagcatgtacttagcgcaaacagtgcccttcagcaaattcctaggcattccctctgaagcacatatacactttccctatggctcataagccctgggaataatggcatggagatctacctgtcctgcagctgcccaagagcatatttctctctgtaagttcccaataaactcaccctgtaccgacaaactgactttgtctgcctcactctttggtttcttgggtccttctgtgtttgggggtttatttgcacatatgtccctttcatgaagcagatgcatttgtgatttttttgaaggtttataaatccccctaatattaatcagaaacatttgacatggcagaattgggacaaattagagaatttgaggcaaagaagagctttccaagcccctttggtctccattttctcatctaaaatacaaaggaaatgaccagggaggttcctaggatctccttagctctaagaggtcataaggaaatcctaaactcataatgatatagatgatagaaatatctaagactgtgaggccagaaggaagtacaatatgatggtgacaaccgaatgaagacggaaacagaaatcactcagagttccagtccacgtgattccttaaaataatctcctgtcctggagggaacctgagaatttccacttttccaaagaggctaaggtagggacaccagccaaggtaaatggatttttatgaagaaagtactttgaaaaaaagaggatttgcattcattatgggaattattcctcaccattgtgaggtggagcagagggaggaggaatctgtggtgagttgggctggcaccaccggccatgcttctgaacctcaaacaggacatatctgaggccagggttgaatcctgactaggctataagccaatcatggcaaccccttcagttgggccagtgctgggtctagaaaccgacatgtgacccagttctggccaatgagactcaagaggacactgcaagaggtttctagaaactattttcattcaaatgaagaggaggaagctttctctgctccttctcttccttcctgctttggacatggttatgtgtgaatatgatacttggcaatcctactgccatcttgtgagcaagaggagaaggcctagggaatcaaagacttgctcatctgctgtcctgcctgaattcggcagcagaatcagccctgaaactgctgcctcacgatataccacaggatgaaaatagtccttaattaggccctattcacaggaaatttaattaccattaggcatatacagtctatatgatttaatttctttatgctatttttatagaaaaattaaactaagattcatatgaatttgataatatcccaaagaatccctagctacttatttggaagatgtaatctgaagcactggtcttccttttctccactgccccagagtttctccacatcggcactattgacatttgggctggataatttgctgtaggggctgccatgtgcataacaggatgtttagtgacacccctggcctccacccactggatgccagtgccctaacacccccagatgtgacaacccaaaatgtctccagacattgctaaatgaccttgggggcaacttttttcctgattgagaaccactgcaccagacattctttgttcattttcttttggcctagcatgaattagtagggtcttaagcaaagagatgctataaatgttctctttccaaatatatgaatcggcaaaagaggagctcataagaaaggcacagggaaatagaggaagaacttgaaataagtgatggctaatgaaagaatgaagaggaaagaggcaaataaaatagtgcagaaacagttaccaaaccctggaaagaaaaggaactgcattgggcaaatcacagtgagaacacacagcaattgcactctggcagggtaagaatgtgagattcagtttctggccatggccggagtagttgaagactttaagggcagcgttttcaatccaggatcactgtagttggttctactacatttcagaatgaggacttgcaatccttagaaaagtacatgggtctttgggtgcaggttctctgtgttgcatttaagcacttgctcattttgaccctgagtatattcgtgtaagaatctgcctagaaagcagatccatgaataacaatctaagttctgtggctttactttttcatatgaataggtatttttatattttcttaggcttccttaaacagacatcagacacatatctagaataaattatctgtagttgtgctatcttccagatttctgcaatgaaagtttctattaggggtatgtgtattatactatttaatattaaacattagaccttagtgagacatataccatgtagtggtagtttcgtgtatgccaggcactgtgctttacatgtattaactccttgaatcttcaacacatctgtagcacctacagcccattctacagatatgaaatgggctgagatatgataagtaagttgctcaaagtcactctggttgtaaaagacccaagaatcaaacaagctagtccagagcctatgatctcaaccacttcattctgtaaagtaatttgtagatccttctttggtgagactctcaaagaaattagcttcaagtaattttacccccaactctgtaatagcaaatttcccttcatctaggaaatagcaggtttccaagtgctagctaaggaagattcaattttgttaccaagcaccatctacaatcctatatttgatttgttcatgtccatttcattaatttcaactgaccaaggatgtagatgcatttggtgagtgcagaggtccctggagttcatctttagattcttactatattccaaccactattgtttcatgacttaattgaagtcttatttttctattctgatattttttcaaaaattaaaaaaaaatcttcctttttaaaattttcatgtacgttttgccatagaatgtaacaaaacagaatgttagatatgctcctcgggaaagcttgtctcatgctatgatatcaactaagcatcatccctaagcctatctctgcaaatgagttacacaggaaatgcagtgcctccaaaaagaactaagctgaagcactgtgcagcctctgataggatgggtgaactggggcaatagttatctaatacctctgagccccacctcttccatttataaaatggaagcaaaaatatccatccctggggatcacagtgaacgttaaatgagataatccattgaaagttgcctcacatggcactgagcacacgttccagacatacaagtaaaccttagttctcttttctttctcttatattaagattctatcacaaaattcagaaataatctctcacctactctctaagcatcatctgttggtgatgaccgtgtcacccctgctttggaaagacgttgagagcttagaagggcattatcctgaagattaggtataatgtcaaaaatgttgaatttaaatcctggtttctttcccagtgcagttttggaacatttgataaaccccttagactatagtctatggtactgccatctaaaagagggctctgggcttgatcactgctaaagtccccttttattctaaagaccctaactacataatggcattgaggagaatcctgttattaggagaccccctaggtgtttatttgctccttgtattttgttacttattacatgatgtatagctcattttgcatttctgtaaaggaatacctgaggctgggtaatttaccaagaaaagaggtttattttggtcacagttttgcagactggccaagaagcatagtgctggcatctgcctctggtcctacaaagcttacaattatggcagaaggtgaaaggggagcagatgtgtcacatggtgagagagagagtgagagatgctagggtctttaaaacaaccaactctcagctgggcgcagtggctcacgcctgtaatcccagcactttgggaggccgaggcgggtggatcaaaaggtcaggagatcgagaccatccaggctaacacggtgaaaccccgtctctactaaaaacacaaaaaattacccgggtgtggtggtgggcacctgtagtcccagatactcaggaggctgaggcaggagaatggcatgaacccaggaggtggaagctgcaatgagctgagatctcgcaactgcactccagcctgggcgacagagcgagactccatctcaaaaaaaaaaaaaaaaaaaaaaaaaaaaaaaaaaaaaaaaaaaaaaaaaaacctgtcatgtgagcaatagagcaagaatgcagtcattactgaagagagggaatccagccattcatgagagattcgcccccatgacctaaacacctcccaccaggtcccaactccaacactggggatcacatttcaacatcatatttgtggggagtgaacatgcagactataatacatgatgcattttggaatagggactcattacatcatatggtaccctggtcatcatgtatccacaaagggtgtggatggtattcatgcataaataaaactcaagtagattcctaagactatgctacccttgttaaacaacattatgatttatgcaggacatatatattattctaatcagtctagatatgccaatttagattttactgatgcacttcaaatctcttaaactgagagtaatgttttcaattacaattttataagcaaacagaacattaatcaatatgtgagtaaactattgccctgtcatctgtactatagaaacccataaacatttttaaatagggatccctctgtagaaaataagtcttctttaagtccctaattccctagaaatatttattgggggtcccttatccaattcaaactctctggatagcagaggatttaagccactgccatggcctgaatgtgctccttccaaattcaggtgtttccagtgtgatactattaagaagtggaatcctgaagaggtgattaggtcaggagggctcctacctcaggaatggatttggtacccttataaagagttgtgacaaagaaagttggctgtctcttgccctcccaacttcttctaggcgggacacagcaagaagcccctcaccagactaagtagtggtaccttgatcttagacttaccagccttcaagacgatgtgaaataaatttctgtccaatttaaatcactcagccttatgtattctgttgtagcaacataaatggtctaagacagccataagtcacagccactgcatgaagtttgactagaacactaactttgggaaactcagttgtgctatgtcattgatccaaggtttgtgaaagtttacttgggagggtcacacacaagagggtctgaggttgactcaccatcatcaatattcctgtaactcttattgcactcaatgtaacaggatctcctgtctttcattatgcagcttgcacttttacatgaggtataaaatatttggtctcattcaaaaatccctcagcttataaagcttaatttcctttggaaagagatacatacctctatgatctatatacgtagaagtaggtaacagtgtttactgattgcaaacttccctctgcttttttttgtattttaccatctctaaaataaactggcatcttgcaatccatgagagtgttttttgttgttgttgtttcttagcaacatataaagcagtggtacacatcacaaccagtggcatatcagaaatgattatatatgatagatttgcccaataaaattaagcccttgttccatttcagttaaaaaataacacggaagaaaattacatttcaatagtttttttaaatacctaagttaatactgatgtatattaatgcaaatcatttacatctaggtcatctccttctaagagacagatttttagaaagagatgtatagttagataatatgaatttctcattttcaaaatggtagcctatataacccagaaatatatatggtttcctttcctgtgttttgtgcaaaatgacataatttattgtcttttgttgccttctttgtatatgcttaacttatctaaagtgtatcttgatatgtgataaaatacattgggtgggatgacagacatagttttgtgtaatgaaataccctgtcatcagaagaagcagaccttgtaatgagtgttttgctgactgagagccagatatcacatctcagctttatttttgaaagcagagatggtagaggaggcagccttgacaccatggcagatccttgttaccttctgatcttacttgttaaaaactcaagtaaggtcagaaggcaacaaggacctcaggtcctctcagtagtaggaaacaactttagtgaccatcctctcttcacttctgaaatattaaatctttccttttctttctttcttttttttttttttgagacaggtcttgttctgttgcccaggctggagtgcagtagtgatatgctttggctctgtgtccccacctaaatctcatctcaaactgtaacccccacatgtcaagggaggaacctagtgggaggtaattgaatcatgggggtggtttctcccattctgttttcctgatagtgagggagttctcacaagatctgatggtttaaaagtgagtttctcctgaactctctctcctgctgacttgtgaagaaggtgcatgcttgcttcttcttcactttctgccatgattgtaagttttctgaggcctcttcagccatgcagaactgtaagtcaattaaatctctataccttataaatgaccggtctaggtatttcttcatagcagtgtgaaagcagactaatacaagtggcatgatctcggttcaccacagcctcaaactcttaggctcaagcaatcctcccacatcagccaccagagtagctggaactacacgtatgcaccatcatgcctaattaaattattttacttttctgtagagtcagggccttgctatgttgcccaggctggtctcaaactcttggcctcaagcaatcctcctgtctcagcctcctaaagtgctgggtttacaggcatgagccactgtgcccagccaactctccatttaatgactaaagacatatacaatacatacattcattataaaccaagtgcgtgggtgtgtatttctggcccatgaactccagcccacaaacactagagcacagagggaaagcccttctaggttgagggtcccacggggacaagctgcctgctgggaagctcccattacagatagtaataattacataattagtatctctcagatatatactaaaacaactctgggtcctagacaatggccttattacttaagaaacacagctattatcttgtgccttttttatgattaaaaatgcaagatcaaagatctgcaagaagatttgctgattcttccaaagtgtatgtctgtactttggaaccacatttcaggtattaaacattatgttttatcaagctgcaaagaatgaaaggtgagcacccttgtgttcttagtatttttcagaaataggaagggccttagaacaaacaatgacatttttctaaccattttaaagggattttgcagaaaaattggctactaaaataatagatctgaagttaaataatcatgaggacccacagctaatcctactaggaagctgtccagagcctagatgtggtgatgcacacactgttacagtgaaggccccttgattcggtgccaacatttgggaaatgacactggtttgaatagccccagacttccttgcttcatcctgtctggtttctggttttccgactttctttttttttttttttttttgagatggagtttcgctctgtcgcccaggctggagtgcagtggcacgatctcggctcactgcaagctctgcctcccgagttcacgccattctcctgcctcagcctcccaagtagctgggactacaggcgcccgccaccacgcctggctaattttttgtattttttagcagagatggggtttcactgtgttagccaggatggtctcgatctcctgaccttgtgatccacctgcctcggcctcccaaagtgctgggattacaggcatgagccaccgtgcccggcctggttttccgactttcaagctgaaggacaggctttatgaatatgtggttgagataacagaaagggtaagttctttggtgggaaacaggctgactgttgcaacgccttcgcagttctaaagcatggaagaaacagcaaggagttcacacactgaatgtgccacacctctgtcttgcagagatacagcagaactgatgggcagagatcagcagttttgtaaaggcaacatgacttatgacttttccattatatggaagttaataactgttgttcatattctatgagaacacataagagaatttaagatgattcaatgaaatgttctaaaggccaaaaaccctccaaaaacaaacaaacaaaaaaaaagcaaaaaatattctaagtactggttcctataaatgtggacccaaacacatatatcagcaaaggaaaccatgaaatgtgcttttcttggattcagtctggctctcaatacaggtgagtttctcctcattccatagagtcctctatgggaacgcacactaggcggtctcttccagaccttcctgtgaccttgaacaggatctacgggttggccccacatgaaggtgaaagtaatatcctttagtttattcttttctcatctttccttatgtcagcctctggaattatatctcccaaaagaaatttgtgggtgtggaagtttctcttttattagcgctgtaaggggcaaaatagtccacaccaaactctggagggggaaaaaaaaatccaagaataaaacaaaccataaactccattatcaaatcaacacagttttctgtgaagacatttctcttcaaacagacaaaaaaacctataacagcattccacgtggccctgtgcaagccaagagctgagtgatctgagagagcacagactgggtttgcaaaaatggttctcatatgaaaaggtgcagacagcgtgacagtgtgactgaggatcgccaggggagcatggctcccatgggcagcattttcagaggatggagaaggtgggcactcaccggacacgcagagatgctctgttcccactgcgtcatgctcaggctctcctccaggcttgtgcatttcttcattaccacatcccagccacagtaagggtcctgggccccaatgcaggtgctggaaacacacaccaaatggtcaacagaaaggtcgctttacccatgataagatacacaagacaaggcgaacctgtcccttggcagagaggtatgggatttcttacatatgaagcccaatgggtatttaggctgcacactggagagcacagctatctgcacactccagtaagtacctaatattaaatcatttacacagacattttgaaaaatctatgttttaatctaacatacatgacagatgactaaagatgagccaacacgagcattttgctgtcataaatagtgctaaaatcaagattctacaatgttcaaaaacaatatagctgtgctcaccactaccgtcaccatgatcatccgcctcctctttacaacatgtattatttgtttaacacctactatcatattaactataatacaaactatcatagcatgcagacgcttaaacgatttgataggcaggttttatttactgttaccatcaccataatcatcatcgttattaccaccactttattgatgagaaaactgaggcacagaaaatctgagaaattagcccaacaacatgcagatacatccaaaactcttcaacatgaatagttcaaactcaaaaaataggagcatctttcatttgtttactgtagcttaaacgtattaaaattttcaatttaatagtaatttcatatagttgtgtctataatatcctacatatgatatcagaagtattttagatggcggatattttctttttaactttgtctaaatgaaagagttcatacactacatgggcattattagatgagggctgtggcctttacattataaagacaagcaaaggtaaatgagggaggaagaagacggagatgatagcgatggagccagaaatatacagaagataatgtcatgggcacgcaggacattgaacctgggaattctgtgaatgcaccaagaagttggaggggcaggaagcagatgtgaggaaagagagacaatgccagcatggaggtgccaatgacccctcttagaggcaggatagtacttacagtgagggaggtcctgttacaaactagtcaaggactagaaatctggtaggaccagaagtcatggcttaaccatcaaccctgtcagcagggaggtagcgtaagtaagtaatgatgagttgttcatatttataatacaaaataatcattgttaaaacaccaaatgtattaatcatatataaagcagttttctaagaatgtgacttatatttggtcatttaaaccccatgacaaccttattaatacagtacctcaattaggcactacattgactgtcgctttgaaatgaaaaaactgaaggagggaaagatcgatttgaaggctgtacagctagggaagatatgtttacagttgataaatctactgataggtagtaagttattatacaattgtcatttattaattacctaaagaagtgcaaatgatttaaaaagctgtttctcagaagtagggctaggttggggtacaaaaatgtatgaaacaactacctgttcctataacctcattaaaactccttgatatgcgaccatatgcagacatgacttccattcaaaaatacaaacaaggcagttataaaggacaaggggaaagcctatttccctagtagtagtttatactgtttatactaactcacatattctgcagatattttatccatacatataagcatgcttgtgtacacatatctatatatacatatatatattttgttattgtttataggcaaatatatgttttatataataatgatatgcaatacacacaaatgtgattgtgcacgcggtttcgcattttgctttctacaaccaataatctattattgcactattcttgtcaataaatatagctctaccttactccctttaacagctgtatagtgctccatttctttgatgaaccaacatttatttaaatttccctttcattttattttatttattttcaattttttatttccataggttattggggaacaggtggtgtttggttacatgagtacttttgtggtgatttatgagattttggtgcacccatcacccaagcagtatacaatatccactgcatccaatttgtggtattttatccctcacccccttcctacactttgcccctgagtccccaaagtccattgtgtcattcttatgcctttgcatcctcatagcttagctcccacttatgagtgagaacatgcgacgtttgcttttctattcctgagttacttcacttagaataatagtctccaatctcatccaggttactgttaatttattcctttttatggctgagtagtattccaccatatatatgtatcacagtttcttcaacctctccttgatggatgggcatttgggttggtcccacatttttgtaattgtgaattgtgctgctataaacatgcatgtgcaagtgccttttttcatataatgacttcttctccaccagatagatacccagtagtgggattgctggatcaaatggtggttctacttttagttctttaaggaatcgccacactgttttccatagtaattgtactagtttacattcccaccagcagtgtaaatttcccctttaaaattattaactttaccctttaaaagcaaggctgcagtgctcatttttgtatgggttttctatatgataaaattttattcatgtagttataggcattattaaatttggaccaaccaacaatatgggagtgcctctgctgcctcaccctgttacacactggatgttaccatattttttaactcacccaaagggtgagtctttcagaaagctggtatatgaaaaaaatagaatttcccaattgtctgttttcatttctttcagttgtgtcttaggttaaggcttagcatagatgaatatactttttaaacatttgcattttccatgtgtaaacttcctatccatatccaattcctgatttgatctctttcatgagtcattcattttattacatggtcactggaaggggtgatttttgcattaaaatgcagccctctctgagtaatattttccctgtttgacatttttttcttgagatatacatgttataagattttatgcagtaaaacttatgaacacttttctttatagcatctaatgtgtgttccatgttaagatctttctcacttaaatcttcccaacttaaagattaagcatcaaacattatagaaagattaaagattatagaaacatcactcccccgattccttctgattcttctaaggtatcattttttggctccctatcctttatccacttgaaatgtatttttctcctcctcataaacaaacaaacaaatcaaaaatcacaaatacatattaaaaaatctaaacatctcaaaccccacacaaaacaaacaaattcaggtgttagaggaagagtaatagatgtgagtatggtttcttttcccgttattcaaatgacatccttttcaattactacaagtttataacagagagtgtgagcataagcattttaaaatctctagctttgggaatatgattcccaataatgtactattttaaataaaaaattattccaatgatcagtctcattgaataaaacttgaacctgtatttttattgtagaaaacacataaaaattttctcaattctcaagacacgcaattgatttaataacacttttttgtgcagggaatagagaagatgagaataaactatcacaaccaatgactaagaccatgaaaagtgtgcatttattatccaggtgtcagcaatttcttcctgagtaactttgcatgtgcagtgttgttctgtagaaaaatgcccagaggaagttgctggaaatctggagacccttcaagtgcaactcatgagacagacccgggtggggtgagcgctaagagtccttctgctccctgctgtgactccacctggctgtgccaatgagatcgaatctgagagtgtcttcatcttactaaactagccaaaagtgacatatttatatttgcggctcctatggcaaacctgagagtaattcttttattgacaaaataacatagtgtatatcacatatgggaattctctgtgtatgattctttacacagagcaaaagcatagcgaggctacacttagagatcattcaaaaggcctgcattccttttcgtgtttcttattaaagcaacatgaccagtagttaaaattaaacctccaaaaagggaaaaattccacgggctcctcacgtttaccccagacttcccatgcaaagctgcttggagacttaaaacaatgccacagtgttagagggaagtatttcaagctgttttaagtggaaagctgcatgtaataacatctctttcttctgatgattccaatggttctgcacgttcttaacattacacttatcctttaaaatgttaaaatgtctttacaaacacaaatgcccattcaataaaatatcatgtatatttaaatataatttcctcatgcaaaatattttacaccatgggcaaaattctgatgagatctacctttattctaaattatgtcttaagaaaatctattacacaattttatttttggaagctggatctctttaagaaactgtggaaaatcatgggtttccaattaatgcagccattgtgaaagtggcttttctgtattccactttgaaaatgtttttccttgtgtggtaaatatttttaataaaagttttagcttgatttaattattctaaattgtaaacatatgtcatagcatcattttgtaccccataaatatattctgttcaaatataattatcaacattcaattttaaaatttccataatgtgttaatgaccttacactattctcattttacatattaccctggtatttgaaagtatctgaatttagataaaaatgttagtcagaatccgaaggtttaatttttttcaaaaacacacttattgagggtattttttagagctaaacatatatttggagacaggccttaattctaaaaagcaggataaatgtctactttcctttccacatgacaataacatcaacatatatctaaagtatttctttacattttaaaaatttgcaattacgttttttgttagttggagtaacagaaaaataagtttattcattaaaatattttcactgtatttctgaaaagttgagatttattaataagtacaattcctcgtgcctattagattatctaagtatcagtgatgactttatctggcttgtcactgtcacactaattatcattaggtcagtttatttttgatattaagaatttttgccattttgttaatataaaatgtattcttacacatgggattttaaaagtgtttcaatcatgtatcaattcagcacatacttacgagcacttgctatgaagtcaactttgaaagtgctgggtgtaccatggcaaacagacactgtcactgagctccaagaacttcccatttggttaagaaagtaaatattaaatagttacatgataaatatcaacaaccagttgcaaaggaagaattcaaagggccataagagtctggtgaatccccacttcgatgggtgggtgagccttggatgagaggatatgtagggactggaacaaatgggatgaacagaagtgacccatttgataggcgccagcaagaacagaacctttttgcagagagatcagcttgggaaaagcactcagtggggagagaacttggagagtttgaagaactggtaaaatggaggctggacttgggctgaagcttgaggagagaaatgggcagagtccttgggctccactaaagattgagggtttccttgcaagtgttgcatactttaaagtgcttcccaaatactgtgcaagagccacacttcaaacatcaatattaacttctattatcattacaatgattgtggtagtgatcaaactgcctatgaattatcccttccctaattcctatgaaaatctgtcccattcctaagtaccatgttaccatatacttcataagctattcttgtactttaagagctgcaattaaaaacattatctggccaggcacggtggctcatgcctgtaatcccaacactttgggagctaaaggtggctagatcatttgaggtcaggagttcaagaccagcttggtcaacatagtcttgaaccatgttcaaaaatagaaaaattaaccgggcatgatggcacatgccatgttgggaggccgaggcaggagaatcacttgaacctcagaggcagaggctgcagtgagctgagatcgtgccattgcactccagcctgggtgacagagtgagaatccatctcagacaaacaaacaaacaaacaaattatcttacaaaaaataagactgaagaaaattccaagtagacaatagccttcctgagacatccacagatccttcaattggtaaatccaactagaacatacattttcattgttttcctcttctgcaaaactagaacaaaaatacctattcacagggctgtttggagagttatatcgtgctagacagtatataaaaaaggtttttttgagatggagatgcatacagttgttataattagtccctaagcacaatttcaagttattatacactatggatttctgaggtagttgaaaacattctatattgaaaatactaagtccagcaataattcacattacatgctatgatttgtaggtgaaattaatgtacttgatttcaattagtgattaacttttaatacttttcatgtattaaaactactcggcttaacattaaataacactgatcaaatacaatggctgttttttacatttcattttgcacttaatattaaatttaaataattgacttatactggcactaatattaagcatactaagcatatgttcttttagttaaaacccataggcaaatataacatttcaattttcctgaaaaatctgttttaaaattgaacaagattgatacacattttacagtaaagcatttcaggaaaattgataatttaaaaaacagtgatgggattagatagagcacatgtgaaataagcaagtcaaaagttcttcctggatctaggacttgtgattaacttggtttgccagctttggtttctgacctgatgcagagaccccgttccactccctctttaagcactgaatcctgagctgtttatcttgacctccttgtgggcttcaatcattgtaaattttctctagaacaaatataaagtctttctagaaaggccaagactgcctccaggacaaagccaagaaaggcagcctcttccatggctaggattgtaccaggggaccaaaaccaggacaaaggaggcacagggtgtttcaatggcccaacataaaccttccatggttccacgatgtggaagtaactcaccaggaatggcaaccagaaacagctgtgtctatgtgctcaggaagaaaagaaaataattactggtcacttcattcagggagaaacccacaccattggtattccacattctctattccataagtaggcataattataggtacctccaaagttcaccctcccccagtgtcctctcctcttggctaattaagatttaaaatgaagacacaattacttatttgctatataacatgtttttctttttcaagagaaacacttctgtgaaatagggtttaagggtcaacaattatgcctgaagaatgcagaaggtgtcaagtaatacattttaatttttactcaaaaccttaaaagggcataagtccagaggggaaaatatgtattattctgttttcttataattcacctaacttaacagtttgactgcaattgagtggaagaggttcaatgccaaggaacccttctgtgtagtacagcccacccctcagaaagaacatttgtccctctcagcgggtagttacagcaagtgtgaggtctgccttgaatgtggattctctggtgccctcatgactgctgggcagccggtgacagtggtgaaggcaagcacctggctctcttcacacttggccttgtgtagccttcatcagtgcctgaatcccagttgctcttgtgtggatagagacatgttcacttgagacagggaattattgcaaatccatggacagatgctcccgctgcttggatgaggccatgctgacatcactcacccaagcacatcatgtggtcatgctagagtctcatgaactgttgatttgccccggcagagtcaggtaacaattgaatgaaaggagaagaatcctcctctcagacaacatgaagttgtttgaaggcagagcagcaaatgattggctggtcagtttaccttcagtttagtccggagaccatgagaagtatatgtgggcaaagaaggcaaaccacacataaaagagcagtctgtcatttttactttttttttttccttctctttcttgtttgttcattcactttttattttgacttacatctaggacagagggagactttgaatcccagccttcaacatagtgtgcagaaagtgtaaaagaccactcacaggcaatgccagctcagaaggacctgcatgaactgagtatagtattaaaacaggaaaggaactatcttgtgtcaaattcttattaagtaccagccccctaacatagcctctctctctttatctccaataacacactcctatggaaacagggttgagaaataagatacaaagactttgagtaactggcttatggtcacacacacaaaagccccatccagaaccatctgaatgcaaagctcatgctctttccataggcaagctgttttgcaaacatatgagaacagttatctccttaagaattcactggactatgcagcaaataaaaatcttaggagaagtccaggtgctcgtatttagaataactcaggtgcaggggtctggagccaagaagtggtggcagctcaagctttcctatggaattcttacataactttaaatttgagagctcaaaagcaggaggcctgtggagtagatattaaagaagaaaacttttttttttttttttttttagatggagtctctgtcacccagactggagtgtagtggtgcagtcttggctcactgcaaactccacctccctggttcaagcaattcccctgcctcagcctcccgagtagctgagattacaggcgcctgccaccacatccagcttttttttttttttgtatttttagcagagatggggtttcatcatgttgaccagactagtcttgaactcttgacctcaagcaatccaccctccttggcctcccaaagtgctgggattacaggtgtgagccactgcacctggccaagaaggaaactttttctttctgatatcctttagttgtgtttctcaactgaagtacaaacagttggtaatagattttcaaactttacccagctgactgttgaaaacacacattgccatttagagaccaaggacacattctctttgtaaagcagtttcacgtgttgatgggttcttacccaccctgcccagggtctgggggtgttaccttacgacaacactggaatacactgtgctccagcccaagcctaccttggaacccctcttatcatgtcttcctcactgtcctaattagcacttaccacttttgttagtgccagcaccaacaaaaactcggtgcatttactttctgccatttctctatttttaaaaacagatttaatggtggcatccatataatgttgctgtgctttattacatttttgttgtgtcatacagatgtcttcataggtgtcgcttaatggcttcagaataactcaatcagagaacaatcgttgaaaggatgtatcataagtggtgattaattcccttactactggaaattgaaaattagaacactggttatgatacagatatagctttaaaaaataattggagaggaacattaggtgaggagattaggtcctagtgtattccgggatcagactttaaagataaatcgattttggaataaattctaaggcaactccaaggtccttcggttcagttccatgacagcaggtgattttacttacaccagaatttcttattacactctgagtcctctgaaggcagggtcagggatgcctcattcatcatcctctatgcagggccccacttggtgtttggcatgtattgagttcaataaatataatataaaggaattaattacaaaaaatccacattctctagaggttaaaccaaagccagcacaaacaaaaactcaagactttgagatttggcaaatattaaattcattctgaggggataatatttactttgtaaaatgggtacatgtcaaaatgtcctcctgaatgtttatttgattaatgaccaaatgagtaaggttgtctggctgggagaccacgtggagaccctgcaatttctctgtacacattgtatgctttttccattggcagatgctgtctttagggaatatttaattaagaaaggtgtcaacctattaactccggcttttaaaactttgacctttagagcaataaacatcctgtagtaatctaattttccatactaattttttgatgaggtgttaatttctttaactaaatgatactattaaaggctaactgcattaagaacgcccaaataccagttcactcaatagaaccaatgtctttttccttttctttttctttttctttttttcttagacagaatcttgctctgtcacccaggctggagtgtactgcaacctccgcctcctgggtttaagcgattctcctgcctcagcctcagagtagctggttttacaggcttgtgccaccaagcccagctaatgtttgtatttttagtagagacagggtttcaccacgttggccaggctagtctcgaactcctgacctcttgatccacccgggtcagcctcccaaagtgcggggattataggaatgagccaccacgtcctgcccaatgtctttttcttaatggtccatctttccctctagtcttataaggcacaatttaaaaggtgtgactcttttatatgtaagctataatacttccagttcccagattttctctcctttcccccaattagttcattaagcaaaaataaaacaaaccaaaaaaaaaaaaaaaaaacccacctaaggcccaaaggctttcaatccttttgctactgtatgatattgccacatttttctgcaaaggaattttattttgtcacaagaattttgcttcctttcaaggtatgaagtaaattagcagataagggagaggcagaatgtccatttgctaatttaacaaatattatatttactgacccttttttgagctggataccaggctgggggcttcattgaactcagaagcacagaggaagcccaggctttgggagcttatgttcccacagcttgaatgaagcctgtgctggcatgcaggaatttacagtctactttctgttctatgataaaagattaagtgcacactctttcaatgaatgttaaataaaaaattaagattgtatgagtaagtatccaaagggtagaaaattccatggtgttcagaaaatattagggtacagattaacctatgtaatttaataactcatttgataaatgaaatacctaattttctaaattagtgttattaaggaacattcatttattcaaaaggtagatgataatctaacttaggggtcagcaaaccacacagcctgtggccaaattcatacggccacctaaacttttcctgaaacacagaactggggaatgttcctctctggtgactgttcatgagtgcacagaggccacagggcaaggcttactcacaagtgacctaagctttggccccaggatcctccctggtcctggaacgcgggaggattatgaggaactgctgcaaaaccattcctccctcatccctatgtcccaggaaggctgtcaggagcttctcattgctttccaggttctgatgaggtgtaaggctttctgccccttcatatacccgcactaggatacagctttaggctctaaaactgccaggctacagcatggaacgggctcctgagagtacagtgccttagtcctcctgctgcactgtcacctggccattttgttttgttttgttttggttttgagacagagtctcactctgtcgtccaggctggagtgcagtggtgtgatctcggctcactgcaacctctgcctcccgggttcaagcgattctcttgcctcagccttctaagtagctgtgatttcaggcatgcgctaccatgtccagctaatttttgtatttttagtggagacggggttttgccatgttggccaggctggtcttgaactcctgacctcaagtgatctgccctcctcagcctcccaaagtgctgcaattacaagtgtgagccaccatgcccggctgccccttttgttttgatgtcatcctgtgggacaagggatgtggtgagtagactcattttctgctctttttttggctaagtaataaactgtctggatctaaaagcggatcacacttttttcaacagacaaatccatcagccttgcttgacccacacatctacccattcattatggtctatggctgctttcacactgcaagggaagagctgaggagtttcaacagagactggacatctgtgcagcctacaagtgtttctctctggccctttgcaaagaaagtttgccaacatgctgatccactccacacagaggccttaaaatgactttaaaagtccacatcagggccaggtgcggtggcctatgcctgtaatctcagcaatttgggaggctgaggtgggtggatcacctgagatcaggagttaaagaccatcctggccaacatggtgaaaccccgtctctactaaaaatacaaaacttagccagacctggtggcgcatgcctgtagtcccagctacttgggaggctgaggcaggagaataacttgaactcggaagatggaggttgcagtgagctgagatcacaccactgcactctagcctgggtaacagagtgagactcgtctcaaaaacaaaacaaaacagaataaaaagagtccaaatcagcggccctcccatcaccacacctctaagctgttcttttcttagccttgaagaggtacaatcagtcacactacttggaaggctataacattttcttgtgggagaaaataacaacctgatttctagacaagattattagagcacaggtcctgtggctgctcttttcctcctgaattacagaggtgggaagcctatgagttcttggccagagctcatagggtagcaggttctgacttcgcattggtgtttacacaaggcaggaagtcagtgagtggctgctcttggctgctccatcctgtgcctcctcatggagactttttccactaaattaatttattcattgtagagacaggtctcatcatgttccccaagctagtcttgaattcctggcctcaagcaatcctcctgcctcagcctcaagaagtgcagggattacaggtgtgagtcaccacttccagccttttcccactttaaagaccacatgatgctactcgaccatgagccaggtgcatggcctggcccacaggatgaggtcagctttcctgtcttcccctgttactcatggtactcatagctgggccttcccagatccccaaattcctcagaaattagtgaatgtgaactcacttttgcaacttatacacagatgtggtcaataaggcctaaaatgaaaaaggatatgcatgaatagtgcagtttctctggtactctacatccccagagatcaccaccaattccaatgagttagctttgtcttttgaatgattttctcactctatctattaaatggctgtgctaaaaaaaaatgctaacatcaaaacacaatttttttactcgtctttgaggtcaaacttgacggaaatataattttgaaatattgatcttttaaaataactttctaaggcaacagtgctatgttctgatcagtcacaacacacgtgtggtcagtacaggcaggtgttctctcaccactcccaacccccgccgcctgaggtcccaggatctccttaagaataaccagggaatggagactcagcttagaaagctttggaaaaacagagtataaaacctccttcatgtttgcttgatccagtctgatggcaagcagaatgaggaagaggctaacgggaagggggttgagcctctctcagaagacctggcttctgcctgtctgggtactgaccagctctgcctctcagtttcacacatgaagagtgcaatccagcagctccttcagctgaaatctgaccactgaatgggtggtcctcgttgtaccggggcagcagaaacaaccagtaatacaacatgggcctggggcagtctcggctctgacccaggtctcatgttgcagtagctatgtgactttgagcaggacaccaaaaatatgagctgccatttcctcatctgaacaatggatatggtatgctactttactttcaggattgacataataatcccgccaaattctcacaaaatctagcatattgtcagatatgtgaaagaaatttgtgaaattgtatcagttatcatttatacacattttaataaatgtcattgtgcattgtctttggaaaaaagactcaagaaaattaaacatgtaaacatgatttagaaggagatgggtaatttagataagcagtttccctttttaaatacttcaagattcatttataagactggttttccaataataaatggcattactgagattctatgatggaaagtatattggcaaagaaattagtatccaatcgttacccaattgttttcctattcctatttagtgtacttctttaagcatctttctgaaagattaaaattgcttttgtcaaaaaaccccacaatttttccttataatttataaaaaatgtttgtgcagttatttttttttaaagattcttttctccatggaatgttaactagggagggtttcctatctttctacaggagtaggataatagagaaacacattggaaatattcagagaaatgcttgggttgaaatctttagttttcttttctcgaatgaaatactaaaggaccaggcaaaaactaaccccctctgaggaagggcacacagaagactatagtctatcagttgaaaatgaagttacgatttcttactgcttctctcagagtaaacagcaggatgattaagctccagctataaatgtcaagctccttccctctcaggagcccagtgaagacacaccagtgtcatcattctccttgaaaggaaagagggaacagtgaactcctccccaggcctctgtgcctggagcaccagctcctgtggatccacaagtgggctggcagttcaggtgcatgagagatgccagggacactgtgcctctcatcactgatctgatgcagaacttagttcctaagttgcgtgtacaagaggctgagcgattatgacccagactcaaggaaggagagcaacctgtaaaagatgaattgcctcatgctctgtaagccatgcactcccattctggcaccagaatcaccctgcagacagcacaggcctgcggcttcctgtgggttatcccgtgtcaccctccaaaaaggtcatccttcactgagctggagttgaaagactggtgtccttctagatatattccagctatgacatcctgttggccagaccccaatcctgttacccactgaaccaacagcaactggaggaagaataattccttccctaggctagttctgcagggaacacaaaccagaacacatttcaagcagccagtggttaaatttaggaagtaagcatatataagaatggcagttaataaataccactagctgttattaatgttcacaatatcattatgattagctgggaggttcctggcattattcctcaactctctctctcatttcaaaggagacattaaagacttcattttctagaatcatcttgacaggcttattgctgtgattacacatcaaaaccttccttccacctaagaatactcactttgcagagtgcttaaattttatactctatatattatcctatttgagtctacagcaattcacatgtgttgagtgacaaagtgaattctgaaatacttttgcgacctgggtcaagaaacagcaacaacagggctgggcgcagtggcacacgcctgtaatcccagcactttgggagacagaggcaggtggatcactcaaggtcaggaattcgggaccagcctggccaacatggtgaaaccctgtctctactaaaaatacaaaaattagctgggcatgctggcacatgtaatttcagctactcaggaggctgaggaaagagaatcgcttgaacccaggaggtggagattgcagtgagccgagatcacaccactgcactccagcctgggttacagagcaagactccatttcagaaaaaaaaaaaaaaggcaacaacaggtctgttccatgaaccctagcttctgagttccaaagccagtgtaacttggcaccttgtttagagagagagtggcctgtgtagggtagatgtctgtgagtgatatatcaaaaaggactatttctactccaaatctgcaattacaccctgctttaggagtggaattaaacaagatgcctaagaacatttaagattctgatttccccaagggcgatcttttgtcagggatcagagtgtatatacaatctcccggagtaaagtgctggtcaggtgtgtgatgtatacagtactttttcatttcctaagtacctgggccaacatgtttccaaattaaactttaaacacaactgtggttgatcgtggatgtcccacggaagataagactggcctgagggtgaaggaagatgcaatgactcttgggtttccctgtggctggagacctccctccctaccctctctgcaggctcaggagagaagcagcactccaggggagctggtgccaaggacagtggcgggggaggggggggtgtcccggaaagtgggtgccactgcagcaacatcaaccactccttcttctcaaggggttatcagcatatgagctgtggtcgagaaggacgtataccttataatattttttgttatttctatattcaaataaaatacaagcttgaggccaggtgcagtagctcaagcctgtaatcccaggactttgggaggcagaggtggacagatcacttgaggtcaggagttcaagaccagcctggccaacatggtgaaaccctgtctctactaaaaataccaaaattagccaggcatgatggcacacatctgtattcccagctacttgggaggctgaggcacgagaatcacttgaacctggcagccagaggttgcagtgagctgaggtctcaccattgtactctagcctgggtgacagagtgagactgtgtctcaaaaaaaaaaaaaaaaaatatatatatatatatatatatatatatatatgtgtgtgtgtgtatgtgtgtgtatgtatgtatgtgtgtgtgtgtatatatatatacatatatataagcttgtgccagattaacatattaatacagtcatcaaatatcagtattaccactgagtgttctaaggcactgaataatttattttaaccctgacaacttcttacaggtattataacgtggctcctcctctgaggagaactggtgggttattctcatcacagtgaatctattttaatgaaagctctgcatcctagagcacaggactctcagaggcatgaagggtggctctgaggccattcaacttcagggcatctgaagcctccctggctctctctgggtgggcccttcacacacacaccagtgcatcctgaccccggagatgccctacctgcgtgtgcggtagaactggcacctcttcagggggatcttgaccacgtgctcccgcaggcccacgaacaggacactctggctgtgcaggatctgcaggctcctgatgggctccctccgcctctcagggaagagctcaatctcttccagcaaacagctgcttgaggtctgattcaggggtacccgcactttcttaatggttccgtaatctatgaaggtcacaggatgaaaaggaaacaaggtcagagggtctcacaaaccaatccctggttaaacagagtgtgctgtgtatgcagccatggatcttcagccaggaaagccatctgagcatccttcaaaaacagtacacctggacaccactgcagaccagttaggtcagctgcactggatgtggggcccaggcagcagtatcttttaaaatgatgctctcatgtagcaagggatgaggactaatcatgtccgattggacccttccagttccaagtctcgggatggagagctcaaagtagcaagctttgtgccatcccatggaaaacatcaggaaagaaagaccctcaagggacgatcttggattcttagtgacagagatgctgattttggtgcccagcagggcaaggaaaatgcaatgtgattggcagcttcaaatatccagtacgactgtgatgccccctcctccttcctgccacgagaagtacaccctcctccatctccctctctcctctgtctacattagctccttctttcctcctagtgcttgctctttgggatgattttcttgggctcaactcctccaaactttctttcttgtgcttctgagtattaatttctggcctgatccaagccctccccgctccaggcttcttgctccctgggtgtttctgtgcacttatttatctgcttgactgctagcactgctggagggtgagcggcccctgagccatgcagccttcccagcttagggggacacacagttgaaacgaacattgctctcccaggtaccctgtgctgcaccccgcaactccttgctgacaccctgcaaatcccaggcatgaaatccagccttctggaagccgcttagagatccactcaagtacctggaatcatcctgaaggccctgactgaataaaaccttccatgatcccgagtttcaaaacatcatggttcttattttgcaaacacagaaaatgagtttaaggagttattctaaaaccagaagtagtcaagaatatttgacttcaaggcctcctatcaagcaattcattgcaaaagaccttggataaaatactttacatttttctctctctatgaaagccatagagatggaggctatttgtgtttaaaaaaatacataagcagacatgttttagcctgaatttactttaaaaagcatatctgaaacatctccagtgagcattttctgattatacactgactgaaaaatcatgtagacagtattggcaaacaattgcttgctttcattttaagctaactggttaaatatgctactttttaaaaaggtcaatcatacactgaagtatgctatatgcggggaagattttaaaatgatcttgaggaaagagcatgtatttgtgttcatgtaaaagggtgaggacaaaagagagaacgagagagggaagagaaaggggcagctgtggcgtagagaggcagacattttagcaaattcacagttcacagatgtaagcatgtaagaaaaaatttatgtcttaattctataattcaaattaattttgacttggacatcacagttcataagcttgttggaaaattcagcctcaatgattcttaggtctctctgcctggggtacagcgaagagtcaataaacttacacagcaccaaggaactaacagggacaagatgggggcttcagggaaggtgacatcagctcacatgtgtcagccacaggccctgcaaggaggtccccatgaggcaccagcagagggaggtgtcagccttcctgtggagcagtgatgggcatagagcctgtggctgcctttgcgacatcattacacaagaggacatcatctgagacacatgttaggagggaggcaggggaagcaaggctcatgggagaacttatgtgagagacccctgggtgaaacaggagctttcatagaagttcaggggtgggtggcctgcctagagtcaggatccagctggaggatcactgtgctgtgaccagcgtcacactagttgttcaccagcctagagtggcatgggaaacagagtttacagaactatagcctatctgagaatttaacaaagactcattgctgtttattatttattttgttgaaggattatgattctgagaaacctgcccaaattaacaacagtccaaatgtcaatatgctcatatgtatttcaaattcttaagtaattgtggaaagaatcaaatttttaaagatctgtgatagtttgacttaaaagagtgagccatctttgatcataaacttttactgcatatttctgcataccttgtatctgattttccaactagtgggaactaacaaaactacagggcttagcatttcagagcaaagtgctcagcgtgggcttgcatgctggtccacaatggatgaccgtgcatccttcactccctggagtgtctagtcatgtgacgagtcccctccacagttcccccttccctctgcatcaggtttagcacacaaagacccttcctgtctccttgaagctcttccttcccctgcctgtgccctgcccttgttctgaactcctgcatgctcacatgtttggtcacagccttctcatcccctgtcctcatgattaccctagggtctgtcttcaaagccgggatctgtcttcaaagctgaatgttggctctgtatctgcaactcaaccgttagggactggagacaccagaaacttgacaggcctccctgactctccatgtggcctaccagcatgtcccacctcctgtgaccttgtctaagggacagcagcaccataatcccagggccgatgatgggacctctccttccctgtcacccacagctcacctagttctcgtccacccgcccctgtcatccctgccactcctgcagcttcctctacacctctgtcacccacatctcactgcatctagaggcaggctccaggcatgcacatggtggccccatgctccttcatgcctccatccttgcctgtgcctctctgtgctctggcaacggccaccaggaagcacttgcagcccaagagcctgtgattgtggcataccctggacatgcagctcctttgcctgaggtgacaaatgacaatgttattttctttcagtggcagaaagacagagatggccctatagaagagacaccccgaaaaaccccatagatttctatttgacataggaggacaatagcaggaccctggtggatcttgcaaagctatttgtatttggttgctgtttttactttacaacatttaccatggttttagttactaacttacttgttttgtggtttttacacttgatcttaggctccatagggaaaagaactatgtcagttgtgtcatatgatgtatgtgtagtggctgctattagggccagtagagattagatgtttcatgaatatattctgctgaaagactgaacaaatgagtgagggaaagaagtgtagccagcctggaatgagaatgtcattattactcccacatttgctaaagagcgctgattaatatttttcccattataatctctagcaggagttatgatattagtcagtgtgaaggtgaaacaacaaacatgaatttcaccaatatggaaagatttcaacccaagatgtcataaactaaatatgaatgaagaattggtttcatccaagaaaatattaactccgaaaatttgccacaagaaataaagccatacaaaacttctatacttctgaaatttaatactctaaccaaagttatttgcatgaaaaaaagtgccagaaatatgtaaaatcttcttaatcattctttaacattcagagatcaacaagtaaaaaaaaaaaaaaaataggcatttcctgtccatttcagttccccttcccaaggagagacgacaatgtgaggtggagctgcagaatcagtgctgaccagaggatgctcagaatggacactgcttcagtgcaaactctcatagtatttgccatttgtgaaaatgtcccctactcattatgctatggacacaaatctgagtgtcatctatttatagtttctctctcaaatagaaaactatagatactcatcatgaaagggacagagctacttcaagactttaaatatccattagtgttgatatggttattattcaaaagacacaaatacttgtaattacatgaaaacatcattaaatattatacttcactacatatttgtctcatcttagcagaagagaagggatgttatattctagggttaccagattaaatacaggctgccaatttgaatttcagataaacatgaataatattttagtattagtatgcactattcaatattattcatgatttatctgaaattcaaatttaagtgtgcagcctgtatttatatttgctatatatggcagccctattacatcacatctcctttgatcatcttggcaagctagtgaagatatgttggatatatgtagcaacatattcctactttataggtgacgatattgagttttagagaacagaactgatacatattttctatgaactggttagacatgaaatgccttttcacttcaatgttgatgaatgaaataaaggattataacaatggactccacagtgaacattaattataaggctattactgaggatacagactgaaacaggggaagaggtagttgtgctttgattgcattgtcctttttttctatccgctcttctagaagtcatagaacttagccaactggagggcaatgaaaagaaagtcagtattctaatgaatgctgaaaaaagctcaatatcattgatcatcagagaagtgcaaatcgaaaccaaaatgagataccatctcatgccagtcagaatgattattaaaaagtccagaaacaacagatgctggtgaagctgtgaagaaataggaatgcttttacactgctggtgaaaatgtaaacagttcaaccattgtggaagacagtatgatgattcttcaaggatctagaaccagaaataccatttgacccagcaatcccattaatgggtatatactcaaaggaaaataaatcattctactataaagccacacgcacacatatgtttattgcagcactatttataatagcaaagacatggaaccaacccaaatgcccattaatgatagactggataaagaaaatgtggtacatatacaccatggaatactacgcagccataaaaagcaataagatcacgtccttttcagggacatagatgaagctggaagacatcatcctcagcaagctaacacaggaacagaaaaccaaacaccgcatgttctcactcttaagtgggagttgaacattgagaacacatggacacagagagggggacaacacacaccagggcctgttgggggaaggggagtaaggggaaagaacttagaagacaggtcaataggtgcaacaaaccaccatggcacacatatacctatgtaacaaatctgcacattctgcatatgtatcctgttttgctattgttgttgttaagaagaaataaagaaagaaaagtcagcattctcctccattggaagactttgtctgtcatccatctcaaggacaagcagaggcacatctgtgtcagaaggcaatatgttcttctggcctcaatgaccccctccctctgtacatacaaggtggactcgagcatccttgggcaaacagtgaaggaccttcctgctcccttaaaccaactgtttaaagagagtaacatgcaaagaaaagttcacataactatagatgagtagaagttatgtgtataattaaatgttggtgtttctgagaataagataaaaggatgatttcctaaagaaacaaggaccacataacatgctgtcaccagaccaactctcgaacaagcaaagggcttcagtggcatgcctgccaatgagaagaagagaaccctcctcggcacagatcactacattgtaggtctaaacaattcttaatatatatatattttttgctggtgaccaatgcagtcaaagaagaccaggagtaaacctgatgtcaggtataaaatgcagaggtaaaactggattaccataatgacagagatggtcccttcaacctctacaatctgagtcattaggaaaatgaccaaaagaaaaagcaaaggtcataaatgaaaatagtttacaaaggtaaagtttgcacactgtcacacaaaacagtagtagattccattggaaacatgactactggagaagaaatgtttacacaatgcttatcaaaagacaggagtgtaacttgaaaaggacaaaaagaaattacccccaaagaattccagccacaagaaatgacccatgaaacactgaatcttatattcccagtccccatcccacaggaaaacgtgttcatgtcctggaacaaataagttactaagtacactgtgggaagaataactggaaagagaaatgtgttttttagtggggaattttttttttttaatgggagtttgaatgaaatactgttcttagagcagaatgtggcagtaagtaaagctaccaggataaattcctaatgcatttcatgggaacgcagtgacctgaacgcgggaactggggaagcagcaatagcaattaggatccccacaaaaaccctcaagcactgaggtttaggaggtaggaaccgaaagggtttatctagactagcactgtccaatggtgacacatcagactccacaaaagtaatttaaatttttctagatgccacatttaaaatggaaaaaaggaaacaggtgaataaattttaattatatattttacttaacccaaggtttccaaaaaaattatgtgatatatcatatgtaatcaatataaaatatttggatcttttatatgaagtgaaatccaagtgtattttatacttatagtccatttcagttcatactaaccacatttcagctggccagagacacatttcagcaggctgtggctaatgtacgggactgcctgaggatgtacaggggtgtcctggtgctgctctggagagccaggtactcctggctacacgcaaacaagagacaagtccaaacccacaacatcatgagcttcagttttctgcatttcacatattgaaccttgccctatttttcaaatatagaggtccttctctataagtgtttaaaaatccctgcaccaggtcaattgcctcctctttcaagtaagatgatggaggttcaccaaggtgaagtgacagctcacagctacacggccagtaaatgtggccatgagaatggaacctggtctctaaatccttacctggacacctgctatcacttgctggcacacagctcacaggcagtggcagatgccctgtgggagtgaatgccatgtaggtagttcatttcagaaacttattgatggacagaaagcaatcacgaccattagaaaaggttatttctgtttttcatctgtttgctttgtagagttttctatctaccaagaagtcaagttagttcctacttttctttggagtatagcttctgtgtctcttttatgaataaccctgactgacctcccaaacagaaacactgcggccaacatgattttccatcatccagagcctgaataatccacatattaaagcaagtgcaaatcacaggggaaatcagatgtatttattcctaaattaagctaacaaggaaaagcaagcaaaggtatatagcatgatgttcaaacaaacatgtgtgtgtgtgtgtgtgtgtgtatatatatgtgtgtgtatatatatgtatatatatgtgtatgtgtatatatatgtgtgtgtatatatatgtgtgtgtgtatatatgtatatgtgtatatataggaatatatgtgtatatgtgtatatatatgtatgtgtgtatatatgtgtgtgtgtgtgtatatatatatatatatatatacacacacacacacaaaccatcttttcttccttaatgtaagaaatgcagtcgatttccttaatccagcaagatacattcttggggagactatgagtgatcctactgattttggtcatctctaaatttgaaccttctttcatcattatattttccaagttaacctttcaaacagtcaaagatatgatggatgttaaggttggaagggacgtaaaacaatattttaaattgtgcagttgagaaaagcaaggtccagaaatgttaactgatttccaaaggtcagactactgggccagagtttaggtcctgttcatacggatcaagagctggtttctgaatttttgaaggtatttttgtttcaaaagtataaaaagagacatatgcaatccctataatggtgcctcagtaatagtatagattgtgagttcctaaaaatcaggtgaactgatacaacagcatattaaatagcagttgttattccaggaaaagatgcagctgtgatgtatagacatgtgcttatcttatcataccactgactacacagaaaactagtgtctaaaggatgccaagcccagggcagatcagacttctctatcaggcttcaagctcccatttctatgggctcatgaagcaaacagggaaacagacgatgaaaaaaaaccttctattgctgtttcatttaaaaaaaaaaagaatttagatgacaaaggatttgtttaaacattaaaattgacaataaaaataagccccttaaatcactatttgctatatataatgtagactctcatgtgcataattcaattatcagtggtgaaaaattaaccatgttttttgctctgggggaaaatagctgctattttttaactttcaatgtttaagtagctaacatgaattttatggtttgaacaagattccgttttgcatcttcagagtactggccaatttaaatgaacacaaatgtaacaatatctcatttgtaaggtaaatatgccttatactaagatagagtctgttatgagctgaactgtgtccacccaaaagtcatatgtttaagtcctggccttcaggacctcagcatgtgactgtatttaaagacaggctctctaaagtgatttaaggtaaaatgcaatcgttagtgtaggccctcatctgatatgagtgttgtccttataaaaagagaaggttaggatacaggcacaaaagaaagaccatggaaggacaaagagagaaggcagccatctgtaagccaggaggagaggcctcaggagaaaccaaacctgccgacagcttgatcttgcacttccagcctccagggctgagaaataaatttctgttgtttaagctgctcagtctatggtactttgttatggcagtcccagcaatattgtattatataacaattatatattatgtatataatataatatatatttataatataaatatttatataatataatatatatttataatataaatatttatataatttatataattataaatatatcatataaatatttatataattataaatatatcatataaatatttatataattataaatatatcatataaatatttatataattataaatacatagtatatataattatataatttatataattataaatatagcatataaatatttatataatttatacaattataaatatatgatataaatatttatataatttatataattataaatatatataatataaatatgtcaagagtaggatatagaaataatagattctggcatccagataaactgttaagcgcaatttaaaaactagattataaatatttttttgctttcctctaaaatattgtgattcaaattctaatacggaagcattataaattatatattagattcaatctttttaaccttgtactataaccttgtactcatattatgaatagcctattatttgtaaatgttttcatttatttcacataaccacctttatatgtagttctgatctagaaaagtcgcagggaatgtcataggacgtataacattttgcaaaattaatgcattttgatcaacaatatgtaataattcatatggttggtgctactgcttaaaacctttatgctactgcctctggtgattttgggggaaattcagagagaactaaatgagcacttaagaatgaactttcaagtacctaaagaaaaggtctctgattataatgaatttctttttgaaggatttctagaattttagctccatcaacatttgaaaattttacggaaataaatctttagaaggaagaaggtaaagtgggaaacgaggggtggagacaggagggaaaggaaacacagtgaatccaatataatatttaccatcacaacgagtaaaaacagtgcacaattgtccatacttgtgtatgattagatagccttctatcatcatgagtgcatgaacaatgaaaaaatttaatgcttaaacagtatttacgtgaaagtccctgtgtctcacgtgtataatggcttaaatgctgagacacctgggaacactgagcaatcaaaaaatactcaaagaagttattttgtctcaacaacagcagcccaaaacacttccaaaacagaagataaacatatattttctctaaggtgcaataaaaaacttaaagggtagaaatgtaatatatctgatatatataaaaattcttattttgtatgaaaagaaaaaagtcctacccacaaagaaaaggaaacgaattgaggaaaatgtgatataaaaatagattattgcaaagcattggatggtgaaatctattatctggattccattctctttttattaattctgtaacttttgttatagtttaaggtatttttaaaattattcagccttcagtgtgctgaatccaatagagaaattaaacgtgtgaggaagacaagtggcacccctgacaatggtcacttgtgacaaggctggagattcatgtggacaaggaggccactaacctgggaagctaaattagtttatttccagttgtgcatttggattctatttgattctctgccgctatgtccaagaggcatttctagtgtttggctcatcgacccagagtcactgcagagtaaaagaaaagcttttgtatttgtatgtgttaccataccaagcattatcagcgaggtaatgatgaaatacccgcttccactcactgggcagctcgtcaccatggcaacagatcattatataaagttcatcaattcagctggtcattatcccaaagcagcagacagctaatatgttaaggaaagttctttctcttaacttgtaaacgagcaaatgaattaaattggtcttggcactgggagctcaatattacatttatatagaaaaggagaattcagagaagaaaaaaaggtcttcttggctagtgtatgcttgaaaaggagaatttaattcactcagttaccagattcaactaatggcttattttttccctgaaaaggatagtcagtcggtttaaactttcctggtcataaattaaaagcaaaattttaaaatcacaaagtattaatattttaaaccatattctcatagcctgaccctctgcatgtaagttctggagacccggcactaggggatgcagcctgccttgttcactgtgaccctgttggtttccagaacaaagcctggcacatagtaggtgctcaagcagagacatgttcattgtgtggcctctggggcacaacagcccaggttaaactccaggctcccacaatcacaggccgtgtgaccgagcgcagatccctcatatctctgttgccttctccccagtgcccagctcacagggtcggcggccactaagtgagtttaactgtatgtttgtttggatggtacctggtacacaggacacgttgtataagagtttgctgctattcttttcttattaatgtttagcttgtaaatgataagtcctattcaagttttgtctaaaatcagcaagatccctgctccaccactactcactgtacatatgccaggaggagaaatgacaactcttttacagctgctttggctgccttgctgaacaaaacctcaaaagctccttgcagtaccctaaatcataagccagcgcttataggaaatttaccactgcatttcctgtgaataaaaaccatattacttttaaaacaagagtgcaattaatagagccctctgggtatcctttctaaactctcatctaacccacagcttaaatataactccaatcattctgttaaggaagcaattcaagtttctgaaaggaaattacttgccttagatttattgtatctaaattacaaaacaaccacccagttggtaaggttggcagcccttctctgacagtcaccaggcaggcatccagagtctaaattaccctctagcccccagtggtgaaatttatactgtgtctggtcccattagttgtcaattgagatggttgagaaaaatctatgctaagcacttttgcacttttgaaacattaattctaaaggaaaaaaagagagctctcttactcagtggaataagaaaattattttgtcatttttctcagtggctacattacaccaattacgactagtgcctgatgttccaagctgtttgttagctcgttatgagctttctttaggcactgtcttatccatttctatgatttcaaagaaaacctgaggctgccattactgacctaaaccttcctctctggcttcaaagaaggatttccaaccaactctcaggcgtaccgcatgcaactagaactcagtatacccaaaactggaaactcaatgtctcccctttgtatcaaatctgtccatgcacctgaaatcctgaatccactggctaggatggaatagtcaatatgactatcctactgttcagcttcatctcctatctcttcacccacaattgcagctcatttcaatgtctccccctttccagaacaccccaggactttctagatctgcatgctttgcatattctgtgccctctccaccaggcagccatctccccatcccccaagagccagctctcaggcctctggtccgggtggagtgggaaccttttctcacctcccaggccagctcagtttttccaaagtctgtgtgcttatggaaggtattcttccttcaactaagatagtgcattaagtcaaaccaaagaataaatgtccatcttttatgggacataagctttccttggtgtgatatgctgagccttatccttattcatgaccaccgtcatgctctcgggatacagtaggccgtcagttgagtcttagtgaatgaacatatgaggatttcacaattctagaatcatgcctcagaagtcaatctttaagctcaaggtggaaatatgtctttcaattttcctggttattgccaagaaatagcagaataaccatgttaaaaattctataggtgtccagagcacacaggtcactcctaacttcctatgcacccctctcactgcccactccactgaaagttgcccaagaggtgagaagctgaagtgagatggagtggggtggggatctgaaaaggaaggtgtgacaggaggagagccgtaagtacagcagagtggttcccaagctttatgactagagaagctactcagggagaagcctgagatggaccttccaggtgcatccctgagaccgtgatttgggaggtctgcagtgggcctgaggaccatcgtcaatcattaacaaacattctaggtgactctaactcaaaggatctaggatttgaccaacaataaggggctgtttttagtccatatcaccagatgccaacagtgaggtcagtgatgaaggagctttgagtcttgactattctttaactgccaggagcccttatgtaaagggcttagcatggtgccaaggtcaagggaagcactttatgtgtcttcatcattgttaccatgtgggtgagggggaggaggatgccacggccaagggcctccctccatctcagaagctcttctttccatatattaaaactgctacaggaaaaaaccaatgggcagggatactaccttcaacctgtgagtgacaggggctggatgtacactgcttccaatttaatgcatgataaatagtgtgattcttgcttgacagatgcaaaatctgaggctcgcagaggcttcctcattttctgacagcacccagcttacaagaggtggagggaatatttgactcaaatgcccctggaacaaaggcttaaatgctcctccaggccatgttgctgtggcttgatccctttctaagtactttattcatatattaatctcattcttgttctaaaatcatagtgcattaaccattacccaaagagttacatttaacacacatttgagtcattccttaatgacatcacaagactcagacccctctgccaaaactggaacctccttaaagttaaggatgaagtatttgagttagaaaagatgaaaaaatcctgggggtctaatgtacagcacggagactatagctaacaatgctgtactttacagttgaaatttgccaagagagtagattttaagtgtccttaccacaagaaaaaagcaagcaagcaggaaaagaaagaacaaagaaaagggtaactgtgtgacctcctgggtatgttaattaacttgattgtggtgatgatttcacaatgtgttcgcatattgaatcaagttgcagacctcaaatatatacactttgtattttttaaaaacccataataaccacctcttaagtttctcctatatcttgaatctcacacagtaagtaatgtgtcctctctccatgcttgcttattagtcatggagtaatacatatataatgagtttggctttgttcagatagttggatgatagccacggcatgtaaacgtgtcacacccttgtttagtacttactaactggactttccttctaggagcagaactgtgtaatgttcacgtgatgcaaaggacacatttggccaagatgggcttgctcacctgacattcttctatcattttccatctgctcttgaacaaataaaaccctggcatagtcagacgctctcccactctcctctcccttcaacacatagagcaactttggtgtggcctctagtcaggactgactattccttcagctgcttcatgacaaggaagggcctccaggctgctcaggtctgtgatgggccactcaaatgacactgccctcatgataattacccactcagaactaccaactatttgccctaggacacaaatactcattagttcatttgctcattaggtgaatatttattaagaacttatttgggtcatattctggcttagctgctcttgctacaaaaatatcaacttccaaaggttttctgatgtttggatactgggctcaatgtccactgatttccttcacccgagggaaagtgttacttgcagggaattattttcactgtcagtattccatctgggaggtgtgagccacagttaatggtgcatatgaattaacaagtcaggagtgacaatgccccccttttctagcctaagtatgaacagggtctgtgcattctgagggctttcaaatgcttcagtgtcctaccttccatgtccagcctggtagggtggaggaacctcagctgtgtgcatgaacatgggtgactcatttgcaagaaatgtggaatgaaaaatacatgtgaaactttgatacccaatacaattcttgacttttgtgaacttattttgaagtagatacccatgcatgtcactagtactttgtgccatactccactacccaacatgtacatgttataggaacctactcttagatgcaaatatattaagtctacattaaaaaatgagagacaggacatgcatattgaaataggctgaatatttgtgcccccctacccccagatttagaggttgaaatcctaagtcccaacgtggtcatatttggaggtggggggctttgggaagtgattaggtcatgagggtggagccctcatgaatgggattcatgcccttataaaataggtctcagagccctgccttgtctctttcccctgtgagggcacagggagaaggtagctaattataagccagaaaagggtcctcatgagaacccaagcatgctggcatcctgatttcatggcttttcatcccccagcactatgagaaatacatttctgttgtttctaaatcacccagtcgacagtagttttttatagcagccaggaccaagacaagtatatgataaaggagaccctttcattcaccaacagtcctactggggagtttccagccatcctttgggtggtgccctgtacagagtttgacatgaagcctacactctcctccttcctcgcccccagacctacatattggttgggtcaaaagagctgagagaagaaggggctccatatgggagaggggttggaattcctctgctatcctcctgaaagaaacagaaaaagtgaaagaaaaggggtgagagtgaaaaactagaatgatggcaaaaagatgcctacacctccatcaatccttccttgtgaacacaggtcctcccataatctattcaactcacacaattctgtccttttttttcttttaaaacacgctctggggaaggggttgagttggtgtttgacagtgagagaaattcattcaccctgaatatcaacaggatctggtgagcataagcccaaggattggtaacagaaatgatggggagggctgtggacttcctaggcaggaaattgagagtctgaaatatgaaagcaaacagcaaacatctggagggcaggaaaggcccagttggcatctgaggggcaggagtgacaagttttcttaaacatcagtttggagaaaaattgttttaaattgggactcatggtcgagacgacaagctgaaagattcagtcactaaacatgctccacgctaatgatgcagagtccagggcccccagctctccagcttccattgactttccagtgagactccccaaatcttttcatgggtgcagatttatttatgatctatgaggaatctcaggccagttcttattgggcagcaggaaaatcatgagtcttaaccaattcattgctttccctaactgggatgtagatggctgagagggagccgggttccaacactagatatatgtcctccagctaaacacacaggctgcggcaagggttccagtcagacagcaagagtcagaagacctggaggatgagaggtcagtgcctggagatgggacgagagggagcgggcaccaacttacagggcacagaaacggctctaattctgagatggggatatgtcctaggacacaggacaaagctcagacaccagagcaaagaactgatcacttgagaagatgtcaaaggccaggtcactcaaactgggtgaaaggtcagagctgagccaggacaaagatgaggtagcattgagcctgggcccccgagctcctggcatgccctgactccaaggctggaaaactccagaatctagggaactagaagtgcaggttaagtgttagagggtcccacagacaagctgccaggtgagtcactgcaggtcagcaactccataaagccccagacaactggctattatccaatccgtgcacagagaaatgaatgctgcctagagatattaaaaatgccaacaccgtgtaatcaatatgatttctaattgaaggaagattatagtttaactcaaagagcagcagttccttgtgacgattgccatttaaagacagtttaccaaggacaaatcaaggcatttgtggttgaaactatttttttcactatgaatcagtgttcttccgctaaggacaaggtcagatttttaaaattaatcaaatgatcacatcattgaaggcctaaatgaagtttctactctgacaattaatcttggtgatcacttcaatactaaaaatcataacttttttaactaaaatcccttaactgtacttgggcattcaaaaaattaattactaaatttttatcattgtcacaaacacatgaaaattgaagcctacagaaacctctaaactgttctgggtgtgtagaaatcaaattctacctggcataactgaagatcactttaaaggattttttactaatttcagacaataatgctcaatattttagttacacatgagaacaattcttaatacatattttctggttataagaaagaaatcttcagtttcttgagcaaattttcctttcctttctctcaattttaattcctcaaagaaacatactatgtatttaacaagattcactatactcagttgaaacacagtggttataggtagcaagaaatgcccttctaaacaatgctttaatctcaaaatggtttaaaactttcaaacatagctgagctttcacagccttcaaaatccagaatctggtgataagtgttctcttggtcagaaacttattaaacgtgtgttgattgctcttaaatgggaaaaaaattcaaaagctctttactgctgtttccatattgtttctgttttgggattagtcaaaataatgaaatggcactgttgaagatctgaagaaaggaggaatgcacacagggacagatggcttgctgctttccaataactcattcattcagcatttattttgcacttactacagtcagaaaattccagacagggaaagttgttttcttcacccggtttttttttttttttttttttggtctagaagaataactggctacataattataatttcagatattctcaactttaggagcatctttagtccattcagggtgctatgacaaaataccatagactgggggggttatcaacaacagagatttatatctcatagttctaaagcctgggaagtccaagatcagggtgcctgcagatttgatgtctggtcacagccacttcctcacagatgacaccttccttctgtgtctcacatagtggaagaggtgagggatctctttgggatctcttctattgggcactaatcccattcatgaggaatccatcctcatgacctaatcacctcctaaaggctccacctccagataccctcacattgggaataaggtttcaacttattttcaatctggagggacacaggcattggtatcattgcaagagggctggttaatgacaggctcctttgattcttcaaacaaggtctcgttaacacattgcatgtcctcagcttctccaaggaaatgttgatctgatgagtaagacaggatcgtgtaggaacagcattgcccctagggacatagctcaaaacatcattcctttcttaacattatgaaaacataacattatgaaactccacagcatcctttggtaacaattctgtttaaaccccagaaaataccatacttaagaaacgtagtgttggacttctctaggtttcaaaaaggaaagagagatgaaaatattataaaccaataaataatggagcagatttttaggctgtgttttgaaacaaccaaaataaaagtaattctgatgttacatctctgcaagtgacaaatactgtttttcccatgcctgggacaagtatgcagttagacttggccattgtcaataattgcaccgctgtaaattacagcttactgcagacattctggtgaaaggaaatgttctaagtgttaatttgctgggagatttgaggcgagtttttttccactaatgacttccaggtgggaactgcaatattgacagttgcaccttacttcctactcccaaccctctcttaatcccagatatgtgaaatatcttccttctgttccttaaggtatcttggtatcctcatcttctctgcaaaggcttttttgaaaagatgtggtgaggtaccttttcttccagtcactctgctttgtaacaactcctggaggaaagttcgtctgtaacaccattgttactgctattttatcacgcactggaggatgcacccattccttccatgtccttcagaatgcactgctgtctgttttagaatttaattacagaggtcaaggcctaaatgtgcttagtaatgcctggtcatcattgccaggcaggggccatctatacaagttaacaaggatgacaggatgtgcttagatccaaaataaaaacatcagatactcaaagccaaggcagaaaaaaaagtcctacaaggaatttgacttctatgattagctgtgcttccactttgcaccagtaaatacagcccaagcaacctcactccttcagaaagtctctgctaccgtgcccttcatgttagactacatcataataggaagctttactctacagacctttgaaggcgtaagagacgacagctctgtggtgatctgagcttggagtcagagaggtctccctgagcaaagattccatttgttaacacatcacagcagaatcaaattattccacattttatggttctaagaagtattttgttttctgatttcacagcttagagaatgactgtggtgggccaggtgacaggaattttatatattattctaatattcagcagcaagtgggggtgtggtagagttctaaaattctgctccctgcatccccaaaggaattgcaaaggtcatccagatcccgtgtgttcatggagggtcaagttactcccaagcagtggatactcttttcttgcaggattccttaaattctctcagtggtccttgaataactgggtatcagagacacagcatgccctgggacagagatgcagtcacctcactgcctgtatttctgcctccagttaggcacatgtttatgcctccagttaggaaatgaacacccatcccattggcagtacaaagaaaggaaagaaagaaagtgcagagatggctagaggggtgcaagcagagatggcggtggcccttacacgtttaacactgacaggtaggggtttggtttgttcactgacttgatttcagttagtgggaaattaccctttgaatgccatacaacatatggcatcttccttttgtccttctcttctacattccagaatttttctttttcattatacacatttgctcatggagcacttgcaaaaatggaaaataactccgtttggtggaagcacttcagccaggtctggataactagatgtagagcaaataaccaacgtaattacttgtgcagctcaaaccagaacaatttctccctttaaataggaacagcctcgtaattggagtcctagctgtttgctccaaggaaaaccattttacatttaattttaaactttcaaaattaaaacatatttagagggtttttgggggatgagaataagaggtgtcatctgtaagacagagggcatctaatagacctcctaccataggcagattcctaaaacagtccctatcattcccaacccctggtgttcatgttctatgtagtcctctctggtgagtattggccagacctatgaatatgacagtgtgtcactcctgtgattagatcatgtgacattgccacagtgaaggaattctgcagataaaagattacaaataagttaatttcaagttaatcaaaagctggatcatcttggatgagcctgacttaataaagtgaaaaaccctaaagggaagactgggcctctctgagaagagaggctctccttgctggttgcatagagtaagtggccacattgaagaagggtatgggtggaaagctgcaggtggtcttaggatgtgaaagtaaactctgccaacagccaggacaaaactagggccctctgtcaacaccatgaggaaataaactttgttaatgaactgaataagcttggaaactgactcctcactagtcaagccttcagatgagactgcagccctagctggcatcctgattgcagcctagtgaaaccctgaacggaggacccagctaagcagtgcctggggtccaggaccatggaaattgtgagctaataagtgtatgatgcttgaaattgctaagaatatgataatatgttgtacaacaatgcaagaataacacatcctctgaataccctatttaacaccttgttgaactgtgtgtgaagcccagggtcccctctgaggttagctgtcctgctcttgttgaaaaaaggggccccagttctggcagaggtgacccagttcctattcccaaagctgatggtgtcagaggttggcccctgacccaaggatggccactctgccagctgaccagcagcctcagaagtggcctagcctgtagcatgtggcacattcaggataatggtgatctggtattcaggtcagactctccctctcaggaatgtgagttaaagaatgcacagatgggtgaccactgatggggcagcagaaatatgtatccttaaaatataccccattgcttaaaataacccaaggatttcctcactgccagaataatctaattgaaattaggtagaatttaaatagaattatcagatagggacaataataaagcccatgcttacccagcatgtgggtgccactgtaactggactgctccagcaacacaacagaattaatcccataaacagactcagaggagcaggagcagcagtgatcacagttgattcattggagtgacagtacttaaattcttcctatttggccagatgcatagttacttagaaaccagaaaactggggcagttataggctgctgaagtctctttggaacctggttaccctaaagaattgacttcagggtgcaggttacagaaaatgaaggtagaggacaagatgagtgctttaaatgatggagtcatttcagatgttcttctaattgcaggtataaagacacaactgtgggaaacagtgatgttgactctatcccaatatgcctgaggttctatgagggcaggttgtgttcctgacatagcctcatctgaacatttggagggcttcattctggtggaaatgtatgtgtattttctgttgatatgcattttctgaagtcagtgccttgacttggccttcgttgaagattgacttgttcatctttgttcacaaccatgggtgagttccacgcaggtcctgagaagccaccaaggctcatctccattgtctcttcccaaactggggcatcccaggatactcctaggagatgcaggcctgggctgctgccaggtgaccctaaaagacatcctgcatctcacaggttactagggttatgtggattttgactttgaacccagccttagcaccctattagaactctaaaactaagcatgaggatactggaaatggacacacggggacacatgtcaagaatcaccatccaacagatgaaatggattagctttcgaagacttaatttttacatatttgtcagtataatttcagttctatctctgatatccataaacaccttggcagaacttataataaattggaatttacatgacagtacatcagataaattgaaaccttcagcctgcctcattcaaaaccaacaaaattgatgtctcatggtgacagaacttggatttattcctcaaaaaaaatttagttggtaaatgcttcttatggagaaaataatttttaaaaaactaccgagaatctcattatccaagttaaatcaccagcagaatctgctcttaaatatttgtttaaaaatattctcatcagaatatgttgaacaaaggaaacactttcagttatgttcaatttgcacacttgggtcttacaaaagtgagctcctgagtgaggaaaaaaaatgtataagctctctttcttttttttttctctccttttttttttttttttgttgagatggagcctagctttgtaacccaggctggagtgcaatggtgcagtcttgggtcactgcaactccatctcccgggttcaagtgattctcctgcctcagcttcctgagtatctcggatcacaggcacatgcccccacacccggctacttttttttatttttagtagagacaggtttcaccctgtttgccaggctggtcttcaactcctgacctcatgatccgcctgcctcggcctcctaagtgctgggattacaggcatgagccaccgcgcccagccagataagctctcttttaagacatgccagtattctgtatagataatagttaaaaagtgttggtaatgattgtaaaatatgttttaccacaacaaatgatatggatgaagatggaggagccatttaattgaaagcccttagtacctataaagacctatgttcttatcatcaactagaaaagtcctttgtaaaaacacttgcagattcgtcatcaaattagcagtcaagtgggtcttctcataactgaattttccaggataaatatctgttaaaaattcctaagcctgtgtctacattatatactccagtaactcgtgttctacattagacatgtctcatgaagctttcacgtagaaaatggtttgaatgtccctctgtagaagtagagattagacttagcaaaaaataagaaaacctggggcactgaatcaagattatgaaaaatcctcgtagttataataccatcatctcaaaaagaaacaatactaccctaactgggtttttgtataagcaagaggacagcaggtttgggaacaggaatccactgggcttcatctcctagccactaccattaaacctgaaggagttatatcaaaaatttgtatcaggcaggatctgtatgaaaaaaggtaaagataagcaattttatttacttatgtattttttgtccacagaccacaatttttactactgagggcaacttccagtcaatactaatcatgtgaaacctgagaggaaagtcacctgtctcaggtgggtccaaagcaaagcaaggtggagaggaagcaagagaccaagaagaaaacaggaaatttatctgctccatgaagatgaagttggttgcatcctatttagaacatactgggaaatttactaattcataggttataacttcatattattttgtggttgggagaccaggcatcagctactaaaaatattcagaaaacatgtttaaaagctaaacacattaaaatacaagaactaatgctcccacatttaatcaaacaaaacaattagttgtttttatagcattttaagtggtttggcatatactaaattatattcaacactattttttcattttaatcgggcctaaaacaaactcatactaaagaactaattgtgttcatggagttcagggagtaggagaagaccaggctactctttaaatttgactgtaagagcagatgcagtgtggcaaagtctacccaggtatattagtaacctaggggtgctgcaataaagtaccatgttctggtgggcttaaagcagcggaaatgtatttgctcacagttctggatgctggaagtctgaaatcaaggtatcaggagagccatactttcttaagaatctgggtggaattcttgtctcgtgctagtttctgagggcagctgtccattccaggtgttcctgggcttgcatttgtgcactccaatctctgcccgtgttatcacatggcattctcctggtttgcctcttttctcatcttacaagcacaccagtcatattggattaagggtccactgtactccagtatgacttcatctggactttactaattacatgctcatgctcaaaggccctatttccaaagaaggtcaaatagggtactgaagggttaggaatttcaacataccttctttgggaacacactttaacccacaccaccaggtaattgagttgctattggttgctgcaattattccctcagtaaatgaaaaattcattaaatgttatcaaagaagcactcaaattatgtaatgtacccccttcagttgatgggagccccttacataaagaagcacacgtaatgcaagtccagacttggtttggatttataatttctggtgagaaggacagaatttggagtgaatgtaaaaaaaaaaattccaacatgatagtttttcacaagttaatacttgttcctgacacttagatagttgcaaattgcttagaaacattgagtgagataattctcaggagtgatggcagccgtaaatgtattaacttaatttctggtacccagaagggtatccttggggtctctaaagtcttatgtatgttggacaaagggaatgtcaagttctgttcctcactcagccttgccctactttttttagataggaacctgaaaaccttgaaaattaggtgctagaaaaaaaaatttgcagggagaaaagaaaattagaaacagaattttagcatttgttgagctagttggccactatcactcttgcagaagaaacttctagagtacatagaacattgtttgtcttttctacaagttcatttggaaagtcatattgatctcctgactttaaaaaatgattcgtagcaagcaaccataaaaagatactcctctgtacttaaaatgagtttggaagggaagagtgagaacaggggaggtccctggttacatttcctccctggtgctcagggcaaagctaagtgaaggtgacaggcatgagtctcaggcccccaggtacatcagggcatctccgcttttttccctgaggttattctgacctctgcccccaacccttgtgcacctcagaacctccccaacttggggacccctctttcttactccctcattcttcctccttggtgaaatgatgcccattggcagtagtaaatatttaaaagccacattcataggttcacaggatctaacctgtactgaaaacagtcaaaattgcatgtgccaaaaccccaaagtccttacaggtggaattccatctttacctagtattaatacccttcaaaagcactaaacagcatggacttcaggtgctgcccttagaaactattctgttgttgcctttctcacttctccagtggctggtttttcctcaattggcagcccccctggcaccccaccaaacacacacagtcacgcctccttccccagctcacaccctctcttggttccctttggtgctttattttgaggcctaactcagcccctcagccaagtcctctccttccccttggcttctcagcccaggttctaggtctgcatcttggaagattggggatgggattgatagaaacacgttcctctgaggtccggaagggatgcgacagtgagtatgtggagatggagaggggggactagaaacatttacagatgcatttccccatgacaggtgcaaaactgtctgctgacacccacaggtaaagtacccttgccaaccccgcatggtactcgattcaatctgctgtctcccccaaccccctgccccatctcactcccagccgcagagtccctcatctattaagaagttgtctagatgggtatctatttcctgacctctatctcctcctcaactcaccccaatctctctgcaccccaattttccatgaaagacagcacaacttccaactttaatggacctgtttctctccgcacattgcacgtttcttcttaccactgaaagccctgcctcccccatctcatcttcctgtttcgttttttcctatttaacatttaatgcaactgcttgttttattgcttctgccccccaccccaaaaaaaaatacgcttcctgaggacagggtgtctgtctgtcttgtccattgctgaaccctctccagtgaattttggcacaaaaactccagtgtcttcttttcagcaaaggccacgagaagtatcaactgtccaaaccaaaaacatcaggagtcattcttaattgcacccattctctcactcctccaaaacacctgctgcatctgtcagcttctcttcaagaaattaaccaagagcagcatttctcaaactgataggtgttccattatcacttctacaagaagacttctcacatttttcctgattgtcccctcacccatgaaattttactacagatattctgtactgtatatttgcttgtatagtccatgtctatttgaataaaaataagattttttgtccccctaagaaccaatgtttgcttcattgagggtgacatctgcctatcttctggctgagcatgccatgctcacctcctcctagaccaccttgatgacttcaatagctttgaccccagcctactcttccttactcagttacaatgcaatgacatctagaatgcctgcttatttttatacaatggcggatcctgtagcaatacagtactgttggtttagaaagaaattgtaccccaaactttaccctccttctaccctttttgttatcctctgattaattctccaggatgtatagatagtaatctttgaaaacatgcatcatatcatgtaacttcttttctttacagaactttcagtaattattattatgcttagattaaaatctgaatttttaaacatagctagaaggcacatattagctatccctgcctgcatctggagcctagaaactctacagggttgaatgaactccaggcattgttggatctcttactgtggttgcctagaaaacagagggaaggattcaagtatttggtgctaatgcattactgggggtgcaatcccagggctgtgtggtgagggaaaggaatagggagcaggaaagagcaggaagtggtgctatatgatttgttaccatggggctcttcctttatgatgaaacagaaagagacatctgcttggctacatgagaagcctgcccttggacagccgcctggaggtgaaaatggaaggggaattcaccagttgcgttctgcccatacccgacatccctctgggtgaggcttgcttcatggagagttcatcctcctgcacttctgggctgcagctaccagctcttccagcacctgcttgagaagccatatcccactcccagaagcgtgcgatctcatccaagcccaggtgcagcaacagcgccacagacgcctgaccaccagctgctcagcatcaactggaggaacctcctggtcctgcccaggaatctgtcagccacgggggcagctgaggcagagcaaatggccaagggttcagggtcaagtaaggctgagagaacctgcggttgaacttacgacctgaccaatgagcggtccttctctgttgtctgagctcattatgctccattgcaccccagagccttggctcacgtgacaccttattgcttcttcctcagatagtaaaatgggtccccaacacctcacttgccctctttccacaacgtctttcctgaggtttttgttctgattttcttctttggctagcagccaaggttgtctgtttttgaagtaggaatcacagatacattatccctaaattttccatgtacctttatttttgatggaaagattagcctagaataacattcttgagtcacatttattttcctctaatgtgtgtatatattgttctacttgaaatctggtattgagtgttcccctattttggttttactttctcaaaccttctctcatcatttggctgaatttagcccctaattagtcttatttcatgtttgtaaaagagatttttggttttctattccttgagattttcatttttgtgagtgtctgtttttttttattcttggatgagtataacatgctcaattcacattttctttttctcagaatattgcataaccatgtttcacagatttatacagctgcagagtatcctgagaccatgtgattttttttcatttttagttttttttttcctcctcaatacctaaataattatttctgtattcttggaatttaaaaacttacctggctagtgttcctttattctgaattaatattgcacaaatacagtatgctttgaaatttgcagactcaattcttcctttattgcagggtaattttctccaatagtgtctttgggcacaagtttttagctccacagacagggttctttggttcaaagacaccaatcactctgtgtggtccattgtctttgtgggtccttcatatttaaaaccttatcttttatttctacattttccaccttaatcactgcaaacatttactctgtgtctaagctttagctgtgtttttgtttccatgaagtttctaatttaatttttactcttgtagtagaatagcacgtcattttgatcttctatttattcgcttatctctgtgaacttccttttcatctcattttgtttctttcatcatttcaactctgggtactgactttatttacatttctctcccttttttttccaagcaaagtaactttgtggcacatgtcctgctcctgctgggatgccttctattccatttgcttttctgtagactgaagtgacaggacagggatgcagagaaggaagctcagcccaggctccctctttgttgaaggtcttgagccttcatatttttttttcctttttgagacagcatcttactctgcttcccaggctggcgtacaatggtgcaatcctagctcattgcagcctcaaattcctaggctcaagcaatcctcccaactcagcctccagagtagctgggactgcaggtgctcaccaccatacctgcctaattttaaaaatgtttgtagatgtgcagttccactatgttgtccatgctggtctcaaacttctagcctcgagtgattctcctgttttgtcctcccgaagttctgggattacaggtgtgagccactgtgcccagctctattttttgagatttctataaatatttcattccacaatacaattaaccttggggctaggggaagagaaggaaacagaggtgataaacatggcacaatctcacatgagttcagcagctagaagcatataaacctctatatgaatgtttcctgctttatattcatctattagctgcccctgatttttctatgtaaaattttgcaagtttgaaatgaaaaacaatgattcaaaatgtgtgtgtgtatgtcttcttcctttacatttctttagtgcctgataggtgtttttatataaatgtttatgaattatcctctaactaaaacaatttataaaatataacacaaaaagagatcacattccttttaaaaaatatatttattgagatataatttgcatgccataaaattcacccactgatttttagtatattctgagttgtgcaattattgccacaatctaagcttagaacattttaagattatatacaatttaaggttcaaatgcttttctaaacactagaattgagttaaagtgaaaataaaaatgatatatctcatcctagaagggagaatagaaagcccaagactgaatggcattgtgggggagggagcatagaattagaacaaccatggccatgctgtggaaaaagcccagagcggcagccacatgtctggaccaggagtgcatgtgggactgcgagggactgtcacagtggtggggaagagccagtggagaagtgtttccaagtcaagtaagggagaaactcccagaatacctgattgctcagcatgaccttaattttgtctttgtagagaactcaatagcatatgagactccgtcactaacagaactccagtcataaatattctaccatttccacttgactctggctctgagaaaatcttcaaaaaccaacttacaaaatattagcacagtcatgattcagataacatgcctggccctgggtggatggacaccaggagagatacagggcagtagcatgaaaatggacccagaatgtatctggggaagactgctgactcagcatagtggcagcagtgggaaatgccaccaaagaggcaagacgcagatgaactacaccagcaagagaagtctagctcacatggatctgtagacaatatggacaaataaaataaactgacttttcaaacagccattggctggtttcctcccatttgcatgtgttcatgtaaaatcaaagtaaaagaaaatacacctaccaccaaacctggattcccaagcctggaaggatatcaaactgattctgcaagtaaggtaggaaggactctagcttcacattcattagttatgaatgtcttacccatgctctatcagttgataactcgtttaactcctggatatggtatagcaagtgcacccagactgaaaggactctagcatgtgtgctcaatatcagattcttttttagatttacctttttaattgttttaattgaaacatattagatatatatattttcaaggtagatgtgataattagatacattcatataatcaaatcacagtaattgagaaatccatcacctaaaatattatgttttctttattctagaaatatctgaattattctagatttttttcaaatattcaatcaattaatgttaactacagttgccatactgatctattgaacaccaggtctcacttctatctatgtctgtatctgtacccattaatcaatctctctttatccctcccgcttctatatcagttttaaaatcaaatgagatgaatttccctggtttgccttgatgtaactactggggctagttataaataagagaccggaaaaacatcagctttttgaattcaaaatgtcaaaatctctagtctttaacatttctgcttgttgggggttatttggctcttagagggttaaattaaaatgtatattattataccttccagtattcaattccttggacataaagactgtatgttaaaaaaaaatatcccttaaaactgaatatcattcttaattaaaatctgaaaaaaagactatatctccttcaaaatatattaaacagtgctataagagtaaatgaaaagatccacaagttagttgagacatgaaatatgtaattatagaggttgttcagttaaaattgtcaagccagtctaaacaagctgaaatgctttctgggaattcacttttcagtagaactgcttttgtacctgccctgggtcactgcatatggtttggagcagggtttgtgttgggccccgggtatctatggctgttttctgctggaaagtaccttcacccactacaaagttctcctcctcttgagtttaactaacaatccaactagtgagagatggaaactgtcaaagagttctacatatggcatctttacccataatcccaacttgtgattcaaattaacagtatcttgatgtacatgtacaacacaattgaatttgtacacaggcagtagatcaaaagaaaagccaaaaatcaggtttgtggaacaataaagcgaatctctgcgaaatgcatttgccaaatggcacatagtatatcaatatcggaatcagatctgcacatcagacaggatcagatggtctggaatccctgcggcagctgagtcctgagctactctcaacacggtgtgggggtgagggtgttgggagcagcagtccaatcatgctatcattcaaaacagacatgtgcaagcaagtttctagaaacttttaaatagtggttttaaacaatggtaaaagaagttgcttgtagctatggactgaatgtttgtgtccccccaggattcatatgttgaagccctaatcccccatgaaatgtaattaggagacggggctttagggaggtgattaggtcattaggattggagcccttaggaacggtatgagtgtccttataagaagagacataggagagaagatctctcttcattctgtgaggacacaactagcaggcagccatctgcaaacctgtaacagggccgtcaccaggaaatgagtcatcagccaccatgatcttagacttctaaccttcagaaccatgagaaataaatttccgttgtttaagccacccagtctatggtaatttgttgtagcaactgactaagacactcatcaaagtaaaaatagaggagtttcatcagaaatcctcagaagttcactacagttcattataaacacaagagaagcaaacatgacctacttggacttacgtggggagtacgtccaaaggctcaggttgagacctcaggctgctcttcactgacccattcaggtctactcaagaatagcctcaacccccatcaaaatccctcccactcccaaggtactaaggaagtcctcaactgcctcctagaattggaagaagatggccctattctccgtgtcatcagcctggacatttatggtgaaaaactaggaactcttatggaagggtccagttcattcatcccacaaacctattccgtgccgggtaccctggggaaaattaaggaaatacatgacagaataaagagaaacaatccttcctttctcttaacacaaacaaaaatcaacaaaatcctttccttgacctcccatcccctccagataactcatcaatcctccatttcccttccctgaaaagcttctagaggagatgccctaagcagctggttccatctgacttcggccagtgctcttcctcctctccagttcctcctcttcccacagactggccctgaggagcagctgtggcctccatctgcccactcagtggtcacatctgtccttaccttacctgaccactcagtggcactgcctgccactggccagtcccacatctggctcattggttgtttcccttatgggtgcagggctggccctgccttctcagtccctgcttagcttcatcatcacctcctggcggagatcaatgctaactagcaaatgcaggagcttgctgggctgtctctgcgcatctgctgtgtctgctcaccgtcaccttcctggcatcttactgactgctctgtttattatctgctgtccccactagaacgtaaggtccagcagggcaggtgatgcctatgtgttcaccagtttccttcccagtgtttcaaatgaactccacaaatagtaaagattcagtagatagtagcaacttcatgaaaaaaaaaaaaaaaactaactggtaaatatgtggtaaatatgtaactaggaattgagaggttcttagaagaaaaaaaatgtatattattatcagcaacaaaaacagtaatcgtgatccatgagaaatgacaattatacagaacactggacaaagaatggggaggggcagactccaccatgagatggctctgtatgggaatctgaaggcaggaaagagaaggacaagcccacagagctcagccaggtccctacagctggcctcacacacccagagccgtctgtgtaatgaactgagatggaacatgctttctacactctagttgctttggaaactgaagagacctaattgtcatttgtaatttgaaagtatcactgcctacatttgctgtaaatgttccattatttatgccccaaaacatattctttgaacactgccatgtaccaccatccacgcaaatattttgctgaaggcactgtttttgaacaaatgagaaataaccatgacaatcccaagataatatttcacccaacaacatcttccaacaaagcatacctttgtcttaaattatccaaattcaaatggtcttgccaagaaaagacttattttatgaatagttgaggaataatagcaaagaaacaagccattgtctttccaattaaagttatgaccaatatagtgaaaatagattgagatttccaaaaagagggacagaggctgaggaagataagtgagcatcgcgggttttgctggttgcaaaaagagacatcaggcgtaaagcttgaaattgaaattgaatgtttagaatctaaatctaaaacacaaaatcagaagatggtagaaaacccctcagagggggccagagctcctacctgtggccaaatagatgatgtggacgagcgcttctctgccctgcaccacgtcgactgccacgtgggaaaagcggctattgtcctccatgaaggagggcactgtggtcactggctgtaccacctcatgcatcagaatgaacttctgagcatcctgcagatttctctcggtcaggttcacgtacaggccctggtccacggtgccacactgaaagggaagacgggccaggttaccagagccggcagcctggacacccacagctggctgtggccaccctagctggaaagtaacttggaaatcaagtaagccacaatccatcattgaagtatgcaaacatgtctgcttctccatcctccctgcagcccctatccttagcatccttttcatgttagatttgaactcatatcttgggagtctcccaacatcatcataaatgaactgatcagaagttaaaaaaaaattaaagtgggagtgattgctaactttaaacagcagatgcatagaaactcctcctttcccgtcgagttacttgaaagctgtctggttaaacacatactattatatctgcctgacaaattaggtagcaaattgaaaatgcaacaatcaaggatctcatatagatgtattagtttttctactgcagcagggggtctgtaagcaaggcatggatttcaagctgatagcattaggtcattctcatctgtaagatcgaacagcattcacatgggctacaaaaatactgtgctggccttactgttttctacttgtatttccaattagaagaaattattaaaaaatgtttagagtccaggaatatggaaaagaacatggcaaatttataagaagaacaggagatgaggaggtaagggaaatggggaaggaaaggagaggagtggggagaagagagtagaaaggaataaagaaggaagaaggaaggaaagagatttcagatagagcaaatatcatggagatgaacctgggatatgcaaggggaaattcagccctgtacaatgctgggaaataaattcagagctgtgttgtggggaggctggcagatgttatataagactgtttctggcaaggatgaggtaaaaagagggatagaaaggaaagcactgctttcttagagccaagctcagaatcagaaactactaccaatccttctcatgtctttcataaactttaattcctggtacaaatggtgactgatccccagtagaacttcacataagtaggtttgatggaaaagaatttccaggcccataccacctgaaactaccctttataacatgtcatgtctaatatgtggttttataacaggtgagaggtgcaaacgtataagatggaaattgctttttgaaaagtagatgagatatttgtatagcatttgataaaatgctccataagccataaaatgatgggatgattgtagaaaaagagaatctgagagttaaacggatttcatgcatccagtccaaggcttaatttactatcacacccttgcaggggcaccccaagttccacaggcaaggactgtgtgagtttaggtgaagggctcagccctgccatgacccaagtgtgagtttaggtgaagggctcagccctgccatgacccaagtgtgagtttaggtgaagggctcagccctgccatgacccatgtgtgagtttaggtgaagggctcagccctgccatgacccatgtgtgagtttaggtgaagggctcagccctgccatgacccatgtgtgagtttaggtgaagggctcagccctgccatgacccatgtgtgagtttaggtgaagggctcagccctgccatgacccatgtgtgagtttaggtgaagggctcagccctgccatgacccatgtgtgagtttaggtgaagggctcagccctgccatgacccaagtgctactctggctccgtggctctcaagccacatggaatcaggtgagtggcagctgtcctgccacatggtctgaggtgaggtctcgcctctcagtctctgtctctttacctgtccggtggctaggaaaatagttaccctgctcatttctcagggctactgtgagaccagctgagataatccgtggaaagcatttgtaaattaactggaagtccttataaatgccaaagaacaagacaatgtgcctggcactaaagagaagccattcaactaatggtgaatggtaaatgcattggtcttggagcaggacagcaattctatggtctgttgagcttcagtggccagagggaaatgagtgaataaacaaagaagggaaggaaacaatgagtgaatacacaagtagttgtaattgggggggggaggggatgtgctaggaaagtttatataattacagtattaaatagtaacatttggaggtcagagacaagtccttacctgtcaacacatgttttaaaaaatgaaaaagagctctactaggcttgatctaatgtctacgcagaaaggttctagttctgagcatgatgttacgtgtggtggtttacattcctgaaatcagtggtgatacccaagtcacggcggcagttagctgcctacctgctgggtgaagtttgcacacaggtcttgttttgtaagcatagtgtttaaaaaaaaattggtatcttgaaaaccggatggcataatatacaaataagaatctcttgctgttcttaaggaacccagaaaaattggacacctaacagggagttctcggtggcaggggtgaggcaggatcactcgctacgccttgtcatctttatttatatatcgcctgtatcaatcttatttatgactgccagaattgccaagaattggttttgaggtatactctactacttcttggtttattttgctggctataatattccacccagtgcttctatttcaaatagttggaagagtattcagagttatagaatctatgtattggatcataagcaacccacttagctctctaatacctgaaaattttctagctttgccttttatgctggactcccgctgtgtccgtgtggggcactgtgtgactccctgggttcaccatgcaagaagaaaacaataaaaatagtaaaagcacagccattgctctcatgtgccctacaatccacaacagttttcatgccaacatctcttcaagtaattcagtcagtaattctacaatttttttaaatgataataaatatttgcacttttgtttatttacttgtttctaggacaacaaatccattcttgttccagcacactagtgcatggtggtcaagcccacaatcacctaacctcctgcaggagtgcccaattttaatggtccctttgttcacttactcccttgcatcttgctgcaaacatgcttggcaggccgggggcggtggctcacatctgtaatcctagcactttgagaggccgagacaagtggatcacgaggtcaggagttcaacaccagcctggtcaagatggtgaaacctcgtctgtactaaaaatacaaaaaaatgcctggcgtggtggtgggcacctgtaatcccagatacttgggaggctgaggcagacaattgcttgaacccaggaggtagaggttccagtgagctgagatcgtaccactgtacaccagcctgggcaacagagcaagactctgtctcaaaaacaaaacaaaacaaaacaaatctgctttgcatatcaaagggtcctgatggacaggatcagatctacgcacttgctcctccaacaactgcctcctcatccacttaactacatttgagggtctattcgtccatttcaactccatcctttcagagtgacagtaatcaaagctgcacagaaaattctggagtctgtcacagctcagctgtgccactgggcctcggtgatgttttatatcagtgattgccgcgtgtcttactgagggtcagggtctggatgactttgaggactgcagcctctaacagggcagggctctgaagcaccgcctagagtggtttatatattttgtccgaaaaaaatgatactttttgttgctttgttactgttttgagatttctatattaaatgttgaaatatcatgcaccatctctcctaacccattcttcttcctgaatccaattctgctttctgcttctctgattaattagctacttctagtatgtaagtactgcacaaaatcctaaatgtcagtaggaaaaacaagaatttaaaaaatctaaccactttccattgttggttattgcaaacataaggcctcttatacatgtctggggagggatcgttagttcaaattgaattcccactctatgccagtctggatggtttcatgaatgtctgtgaggatactttgccagtgtggttatcaaatagagtaaacataaagaaaacacttgctgtgtacttgtactaggagttatacaaagaatcaccataatctgtaacttgagctccattggagtcttaaataatactcagagaagaacagctcaggaatgcaagcttcctgcctgaaacgcatgccaatttctgcatgcttcattcattatgctacatggactggcttccatcccataatgagagtaagccattcagtgtgacactggcattataaaaccagtcgctcctggccttaggaaatgagatttgctgtgtgctgcaaaggtatcctgatgaacgggctacaagttatccactgcctggaggtggtaaggggctatgaagtttactaagccacgctgttcacagtaaggccttctgcaataaaaacatcactgtatggaaaatacagtaagcattattaattatttaaccttcaggattttattatacaaaggactttcttaaaaggagtatttcctgtattcaagaggagaaaatgagacgaaatatgcatttacacaacatttgatatgtagaaggcaccaaataaatgattcttttttgatttttagagacagggtcttgctctgtcacccagactggagtgcagtggatggattatagctcactgattgaactcctgggctcaagcagtcctccatctcagactcccaaatagctaggactatagatgcatgacaccgtgcctggctaattttttttattattatttttgtagagacagggtctcactctgttacccaggcttgtctcgaaatcctggcctcaggagatcctcctgccttggcctcacaaagcactgtgattataggcatgagcctctgggtccagcccttaagagttatatttatcaaatattttatacagtaaacaatgcacattattcagtgttatcaaaatttactcctaaactatttgcatgcatttttatccctttccccctttgttgatggaaatatgcaataaagatgcataatagatagatgtgtgataaaaatgcacataatttgctcaaggaaagcagcacatggaaagatgacatgtaagccagccatcttatttttaatctcatgctccttcaaaagcttaaagacaacaacaaacacaaaactctttcaaaacaatcataattgaatggtccttgcaaaaatcaaagtaaagtataaaatcactgaacctttccatactcccagttttgggagtcccagatacaggacccacttctaccactgattaataatagtaactaatggccatttagttggaataggctaggattttgcatctgaggaccgaggttggaatcctcacttggctacttatcagctgtgtggccctggccaggtgatctgccccaggcccactgtctttccctgcacatggagaaggcattacccaccatagcactgccaccagtgtgcaagctgatctatctgaagcatctagcacagggtctgggacttgctggtgctaaaaatgacagctgtgataatgatgatgatgatcttaagaaagctgtcagaaggccctccagggaagcctgctgctatggacccaatgtctgtaagccacccaaattcctaccctccagtgtggctgtatatggagatggggtcttaatggtagtaaatgagggtaagtgaggtcataagggtggggccctggtccagtggagctggtgcccttacaaaacaggaagagataccccaaaggtgtctctccaccatgtgaaaatgcagcaagatgtccacctgcaagccaggaagagagagccctcacctgaaaatggccctgctcacgcttttgtcttgaaggtctagcttctaaaactgtaagaaaataaatgcctcttttttaagctacccagtcggtggtgttttcttacggtagtccaaactgactaatacacctgccaactcaccaaacatgagtaaattgcttcatctctttgggtcccagcttcttctgaacactgggagatggatgactcacaaagccctggaagcttgaacctcctgcagttttgtgataacagatgaagggcctccacctcctcttctttcctcagctgcctgcatcacattctgtccttcccaacagggaatcccaccacatttgccaattagcgctctaatcctgtttgtgtgtctctgctgctctgtgccctggaccccattcattagaatgtcattcattagggatcagagattctgaggacacagagcccagcatcattagtactaattgaagcctggattcctaacctgctgcagaatgctggcctttttccgcccagtctcaggcatcacagctgacaaaaggccctttctgggtccaggcgccacagttcacaaaaggccttggtctattgacattagccagcagagtatggggctgtccatgaggggccagggagacagctgcatggtgcatgcacccgcggtttaaattacccttgcctgtctacacaaggcttctgcattcttcatgggggatgccaacagtgcccctttgccccccgaaaattacctggaagtgggggtttgggttgggatacggtagccaggccgagcgcgagttttcttggtacttgaagggcccagagaaggcctgcgcgatggcgctcaggttgaagacgcacacagctgaggccgcaatgctgttcctgggagcggagggagagagagaaggcagtcagagagctcggcagcacctgctgacctccccctatggactgggcagcagctgtgacctacagcttccagaggtctcaagaccacagtctcttaaagatcccaaaaggatgaagtcagagcgtgaatggggctcccctgtggaggaacaaacatcttggtacagaaaccaggctagttagcatttaacaccttgtaatcctgtcagccaggattaattcactcagttgcaacaggggcaagagggaatttgaagagctagctatctgcttcacctttcaaattctggaataaaaagacttccttctccaacggatggcgtctctcatcagcctcatgcagttcccttcctgacctgtttatctggtcactttgcccagcagcagggaaagctgtttgtgtgtgtgtgtgtgtgtgtgtgtgtgtgtgtgtgtgtgtgtgtgtgtgtgtgtgttttaacccagatatttgttttatttgtcatcctttaaaaaaatcaactcaaagtattttataaaaagtgactgtctgactcttcatattttcttttaatgtaaagtagattttaaattcaaagggtcaaagagaaaaatttgacatagcactgacatatgaaatcctgaagccataatttagaattcaggctctgagagaaagtcataaatgggagccctcagaaggtcagtgccctctgactaagtatggaaacagcaacattatttggttaagtaaatttgcattttgagctcagtccgggttctcaaaggggaagtggagataaaacaagaaagcttacatatattttctcttgctctgagacaataccacaagcatttctcatcaattttcttttcctgcatcaaaggaaaggtcaaactccaaaactgaaatacctaccttatatttctttgatttgataaatactgaataggaactaggctctattccaaggactttactaattcccattcatttaatcctcataaggtgaaggaaattcacaggtaaggaaaaccaggcacaacgaggacaagacccttccccaatgtcagccagctactaaatggggaagctggacttgaacctaaggctggctccaaatgcccggattttccccagtatggctccaaatgccaggatttccaatcctttgcaatatctgtgggtgaagtagacaggattctacttcaggagagcagacagtaaacacatccttatggaaaagtagggccttgagggtattgtgggccttctgcattttctccagaagtccagcaccaaggacaaggctcagcatgatgcatacagggcctggcgctggaaaataaaggggcgaacaccagctatgggtttgttcactttgctcttttgactcttcattatccttagagagaatgggagaagttaaaacacaagtacagggaagaaactggcctttgaacatgtgagtggactttaataaggacaagaaaataagtgtgctggagtaagaatggctagacacaggatatcccatccaggcatgccttgggccaggtgcagaggcaggcaaatgggggatattacgaataataacaatatttccctgagccccctgctaagcacttgatacagatcatctaatttctcactgagaacctacagatcctgagaagaccctgacttacaggtaagaaaacagtagcacagagagtttacgcagcccaagtcacaggctgcagagaaataaagcaggatttgtacctgctttgcatggggccccaggtttccaggcagcttccaggtaaaggaagaacctaatcttcttcctgctggcataatgtttctctgttcactacaaccaccaggactgaatgggctgacctgggctctggtgtcacccagagactcccctggatgtcccagtagctgccagtctgagcatcctttaatagtgttgtgggaacacttcttcctgtcccctgtgccatcccctggggagcacaattggtatagtatagcccatgcctgcccctctaccctttcacttgctgtgctctgggggcaaaggacgggcctgtgtgactccactgtgctcctccctctgccctccccgctcttcctaggatgggattgtctacaggaagtacatattcactcgcttcttcagggtctccagacctgtgggcaggcgagggcagcccaggtctagaacatgaccttgagaatgagaaggcttaaagctggaatcagtatgaacaagctcacttggacaacagacctgcagccacctgttccaatctggcttctatcagcaatcaaggtaataacttacaagagcaataaaaaaatcctaccccccaccgcaactttactatctttatatccatatctatacatagtaatactttactacaatctctacagtttactatctacactataaacaactacaatggtaagccaccatttttagatacctagaaataaagccaaatctttagagactccattgtagtagcacaccattttctgcaggccaacccatgctcaagtgactgagaaaactacacagtcgtgctaggaacagaaggagtcggaatggttatcttttccccattcccctagtgctgagaaaccttgacgaatgtacagaggcaaagcaacattctgagccctgaagctcagcccagtatcggacagctttctgattcataagacctctgatcctccttttctttccgtttgaaaaaaaccttgtctgagacatgaaaaggaggtggaaaatattgtgaaatttgagttgggcatattagaaatgcattctcaagacccaacacaaattagtattccagggagaaaggggagatgtagcacttctatctctaaaagtatagattccgtacattgggtgacttctgacatgatgggaatttgcaacactaaacaaatagtctagagtagtctgaaacttatttttgcaactatctaaattgaccatacaccatcttgcaatattccaggcatggtacttttataacttctgaaattggtgttttgttttgttttgcccagagccaggggaatgaagagctaagtaaaccagactctccttgtgcataaaactgatgtcaactgagcaaatgcacatttatcttgggtgtgactacactagtttttaaacaaggttttggaaagaaaatcaacttcagaaactgtaaattgattttttaaagtaacttatcaaagagaagaaataatctctgggttgaagaccagatttatgaaaataaagatggccacggtggagcaaggatatgtgtggagccatccatactagccttatttttctaacctcatgtcagaaagaagactcttcatggggggtaaaagttgttattaagcaaatactaacacaagttaagcagtggagagaccaggaagagaaggttaatgaggaaataagctgcaggtaaagggactttttagaaataccactcatgggcaggcatctgatgcccaagagatgaaaaagtaaattaaaatacttaggaagcagaaaggacatcatagggtgaccagttgtcctggttcacccaggaaaaagaggtttccttagttacagggctgtcatcaatgctaaaactgggataatctcaggcaattcaggactgttggtcatcctacctcatttatcagcacttccaacccatccagattttgatcctttactttgcatacaaatattcagcttttgcttaaagtcttaagtcacaagacaagagatttcaaaggtgatccaaatcagaacccatagtgtaggatcagcagcagcacagccagtgtgtaggaaagtgatgctcagagtctcaatgtgagccttgattcctgggtttggcacgtgctcctcctgagtcttacacagcataccagctaaggataggaaataactctggagacatgtgatactccactagattaagagtgaaagagatcagaaaacttcataagcttaagacagccgaaatattgttcattctaaagttaggagtatctccctgtcccacccccagacaaaaaatactataatttttacaaaaatatttcaaaagtataattgacatttacaaaatgtgtgctcaagtaagcaatcttctagaataatagtgtaaaatgcagctatggaaaatgtgcatttcaaatatgagcaaggtttaagcaagagccatgttatctcaaagatttcagattctccaggcaacactattttcattatacacaaatgcatgacttgcatatagaaaaaatatacatataatatgtatcagtatttcaaaaagtgcccagaacacaatggcaaatcaggaaggagcaatttataatagaataatttaatgtcactatatcctaaagattgacaaaaactttcttgatttggcgtatttttcctaataccagtctcacaaatcacatatctttatctaacatgtagtctactgaaaagtcctctttttttgtctgttagcccagtaaattaagaaagattttctctaaagtaaatttaaaacctcagaggtcaaagaacagaagacttattcagaatgagtaagagagaggggagaaaaattatttcaagttacatacacattggtggtaaagatgccatagatcaaatccagctcaggcaggaagaaagtactctgcaattcgttgtagtaaaaggggacttccccaggacgggagcagttcaggcgagccttcatgaatgtggtccaggtgtcttccagcaggaagcgcccaccaatatcgttcttgcacacccgggcagctctggagaacactgttttcccacagtcatgctctactgcattttctcggaaaaagaagtaggtaaaatttccgatgtcataagatgacacaaagtttggctctggaaacaatagaaaagagggaaaaaatctcaacattcatgtcattcccttttggtcttgcctgctcagtatttcatccaaagagacgtggttttgtttagataacacctggttcctataggactattgggaggccccgtgagcagcttaatgatctacactgttgggaaactcagtgtcatacacagattctaaataatgggaagtcactggtatgattacacactcaagtatcccgagctaaattagggctcaagttaatgggacgttaataccaacaaaaattggcagcaaatatttgcagtacattttagagcaatatgtattactttatttgcaaattcttacataaccttcagagagggagaaaatatgattaaaaagatgaaatgtggttcagaatatagcagtctacaatcctatttgtgtgcaagacaacaaaattatttgacttatatacattcctgtgacttcgacataatgtatgtgcttttactaaggacgttaaaaatgttttcattgttgggaatgaaaataaagactaaaactataaggtgtgtctggaattagctgtagcaatttctgttgctatggtgaccatggaatagtgaaaaacaactctgattttcttatttctggtttgctgggtaaaccatttagaggagggaagagtatggggatggagacattgctttgtagttttctggtctcataattagttttaaaatggggaaacaaagaaatggcaaaattatggcaaagcctttacttaatcaccaagatcttcaggaatttaggaaatatacattatcaactgaattttacatacagcatttgaagttttagcttcctaacttccggtttgaaaccagtgataatagagatagtacattttgagatacacatactccgtaatatttgcttttaaaactctaatcacaaggttttattcttcgctatttctaaatgctattcattcaatcagcaagtatcttaattttctggtgcaaattaggataattatagcagtaacctttggtgtccaaaattaatggaaagatacagacaacaagtatattcacaaagacacattttcagggacaattagtttgttggggcaattcaattggccttgtacctttccagatacaattgcactgcaataataacatgttactggcaggacaactaaaaatatgtgtggctgcaagataagccattaatgttaagagtaagacacataaatggaatcacctaaggtctgaagtgcagaagttgacttcagacattgacaaagggttgggattgactactctgttattctgtccaggaagactattgccaattttcaatcaatacctatattcgatattttcacaaaatgttttaatttaatccaactttacattttaaaaatgtaataaatactctaaatggtttatgtatgatacttttcccttcagtacaatacgttgttaagtcattgaagtatatcaagtaatatactgaggtgattttaatttataaaccgtccaacatattcttaagtcactattgctttcaccctaaatgactgtttaaaaaaaaacttgaattgcataacattgtaaaagatggaggttagatatctttactgtgatagtatgctttaatatcctggagagatgttcacaaaaacagcagattacatatctgtaacttgtgtttttggaaaataaagaaaatactgggtggtgggtgggggggtgttaagtctgtgtttactgtaagtctccaaaacagaattacctgatgaagcaggccccaaaagcaaagatacggaacaatttcaaaaccatgtgtaaagaaaataatactggcatgtctaattctaaataagagtctaaattattttggaatgggtcctgcaccctggctaaacaaaactagagtttgggaattgtactaaaaacaaacaacaacaacaaaaacagcaacaagcaacccttcctaaaatgtggaaaacaaagagagaaggcgtaagggtccaagtgtgtctagcccgggacttaggttaccagcacacatgcaggaggtccaccaaaacttatcaaatacactcactattacccacttctgctattaacttggggacaaatggcatgaaaaccacatagtaaatagctccagtttctcaaaagtcctgagctgaaaaacgagaagatacaaaggaagaaagatcttttatggtttccagctgaaggatgagtttataataaaaacagctaatatctgtagaatgctaagtcttgtgccaagatctgtgcttggtgctttatatccccattgaactcacaagaatcacagagctaggtgctgtgctattcttcccatttcacagatgaggacactaaagcccagagatttaataacttgtccaaattcacataactagcagtgggggatggggatggaaagtcctgaatccattagaccgggggtcaccaacccccaggacatggaccagtaccagtccatggcctgttaggagtcaggccacacagcaggaggtgagcagcaggcaaatgaatgttacctcctgagctccgcctcccgtcagatcagtggcagcattaaattctcataggagcaggaaccctactgtgaactgtgcatgtgagggatctaagttgtacacatcttatgagaatctaatgcctgatgatctgaggcagaacagtttcatccctaaaccatcccctctatcctccctgccacccccagtttatggaagacttatcttccatgaaactggttcttagtcccaaaaagtttagggaccactgcattacactatactgaaaaaaataaatagtgcttgcaaaaagaaaacaatcaaaagctagcaatattcaacaggatttgattttctgctttagaaaaacaatggtaagctcttggctggacagtcatctttccatggagactggtaagcaggtttactgaggaacagtctaaggggggtttcagaaccaaccagagagacaataaatgatgagatgaaactttaaaccacagttatcatggaagtcaggaatgacacagaaagaagaaaaagtggaagaagaaacaactttaaggacttattaaacaagaacattgttggaaagtgtttgacccaactccagagggtgtttcaaggagggccaaccatagcctcagagagccaataaatgactttcacgaggtcattctgtaccctgtgtctgttccagcaaaccacatccacttttgcagacaaggagaagactgagcaatggcaggtagactgacccacagtttcctctttccacagagagcctctaccatatctccaaaccaccctgaaccaatgttataagatcacaacgtccattttagatagaaatgctcaaatacatgttttccttttggtttgcaaaaacaacaaaataatttgtattcagtgtgtagtgagtgctgttctctaattcaccacacagtgcaggtcatgttggtcagggagtgagactgcatttggaaacacatcatgcggccctacactgatccttcaggatgagggtggacccctgactgtgtgacctgccattaactcgggaaacacagtttcttgaaaagtagagcctcttgaaattcggctagcatcctgttcctttttcaaagacaatgaaaaagtgggaataattgtaagacagacagtcaaatagctcttatatttattgatataaatttggaagtaggggatgttagagtcttgccaggcaggatgataagatgaattttgttttccttccattatttaagttctgtcttttctcaaaatgcaatccaccacaaactagtatctgtcactcctgagtgaattgaacaagtcagaaggaaaatcaggtattttcttcttgtctacaatggataggagtgcatgaaagagagatctgaggtatgttgctaactaaatcacagtaaaaacaggcacgtcagctgctgtgtaaacatatgcatggagaaactgttttttctaatgtttgtaaaacatactgagttatgtattaccgtgttgtacaaaatatatcatgttaataagaattcttcttcatgatataagaacttttattttgcatatttacttacataatagtgaccatacagataggactaccgagaagtgactcaccatatatgtaattacaagtgatgcgaagaaaaacatcaaaaattttgagatttcgaccacgcaaaaccaaatactgagaatccaaaagaagcctcccattctatattctttctattccaatgcctaaagcatcaatatgggggtacaccatattcaaatggctcgatctgatcattgagcagatctttaataggttcttgatataaaaatatttgtacacaatgggaatgaatattaaaggcacaaaggaatcccaactctacaaaaatcttactagaatcaaagtcaattataaattattttgcagtcaaaagtcgccttgtgagacacttgccaaagtcaggctggaaaatgcctgtacacgatgcctgtgactctgccctggttggaccattgacatctgatattttctgttgttgcatctgacaatcagacctagtttgcaaagctgtgaaaattaaatgggctgatacatagcaggatgccaataaatggtggctattattattttggcatcgtgtacaggcattttccagcctgactttggcaagtgtcgcacaaggtggcttttgactgcaaaatagtagccaccatttatttactctcaatgtcccttggaataatttctgttgaacagaacttcacataatgataatgaatgatcaagtgtatatatatatatatatatatatatatatataaagcttaaaggtcattagaattttaggagcataaataagtcatactgagttttgtttgtttgtgttttgagacagagtttctctcttgttgcccaggctggagtgcaatggtgcgatctcagctcactgcaacctccgcctcccaggttcaagagattctcctgcctcagccttccaagtagctgggattccaggtgtgcaccaccacacccggctaattttgtatttttaatagagatggggtttctccatgttggttagactggtcttgaactcccaacctcaggtgatccgcccacttcagcctcccaaagtgctgggattataggcatgagccactgcccctggtctaccatgctgagtttttaaatagcaagctatttcacaaaaataagatgagttaacggaaacaatattcagatgtgacacacagccagcagttttctgttcctaaattgttggtatcagtcagtacaaaatgccttccataagcattccctgattttagaccctctctgtattgggtacattgtttccattgtcacagtttatgtagataaaactgctgtagaagcttccagggcaaatctatttttatctagatattcattaaaattaaaagcggataacttaaaattaaattaaattaaacataggttaaaagctactggtaggctaaagttcttttcctgaggtttctactaaaagacagatgatgatagatagatagatagatagatagatagatagatagatagatagatacatagatagatagataatagatagattttaatagatggatgcgcacatttgtgtctgtgtatatgtgtgtatcacatacatgagtatagagatatatgtatacatggctcaatacttccacctactggctgtgtgaatttactcacattatttaccagtatattttctctgtttcctgtttttgaataacaacaacatccaacatacagtatcattgtgagaatcaaacgcactttgctggtaatcatcaaaatacagacctctatttattaaaaataactccaaaaattaatataaacacagatgtgagtaaatagtatcagtaattaataagataactcattgagtatgcattccgtatatcaaattaagatctacacttattccatcaagcctgaaaccaaacacagtggcagggaccatgctacagacgagcctggagccggccagagtactgctctaggcatttcctcactgcctcaaggggctgtcctgggcactgggtgctccttagtaaactgatagacacagcccgtgccctcaagagcagtgtgaggagacaaacaagacagatcaacaagtgcttacagtgaggacaagggtatggagggccagggcagctgggagaaacagaggatcagaaaggagagaatagggaaagggcagaggtgaggctgagaaggggccacccagacaaggatgggggaagagaacatccctgccagaaggagcagcctgggagaagaccataaggctggcaaggaatggaatgaagccacagtcaggatcaaagagatcaacaggacgggaggtggaaagccaggcaaagccaggagcccataacaaggagtatggatttcaactgccattggagagacaccaaagagttttaaagaaaaacttatcactccgtttcctgggtgtgtggtgtgggatggggtaggaagttggagccaagtgcatccttggtaactattttcacagcaatcagggccttgcatcctcaggtgtgtcactcattgagccccttgacagaaaaaagttattgctaagacccttgcagtaggagtggaaagacagttctagcacatttgattccttccttcttcctggggaatatgacccattgaaaatacactactttcatgaatttgctgattcaagtaggaaccacttttaccaaggggaaatgggctggcttcccctaaatgagaagcaccacttcttcacaccgccctacaagtccaaaactcacacctacaattctccatatctttaggtcaataggagttttattaactggatatgtgtctaaatgttctagttcaaagtgacagactttagtgtctactctgctcttattccattccaagcacatagccctctcttataaaattctgccaaatcacacactcctattagttatatatcatttcatgaatatttctgaaaattgtcaaaacacaaaatttctattcgccatgttcatttttctctgatgatattttaaatttacaggttcacttctttgaagaattaatcatttaatctgccagatcaaattaatacaaggtttttattggaatgttaatttaaattttaaaatctggtaaatattttaactcctaaaaaatatgttaaaagactgaaagaaaaccatgtaagattttactgaaagaagacattgagctccaacattattcagttgttatcatacttcttcccaataagctactgtagaataaggaaacgtgcatgatggctctggctttgtctcctgagttgatctgagctggggcaaaaagaagaccaagacacagggagccgacttcccaatatgtggcagtgagtgaacaaatgtcagaggcccttgactgggataaataaaaagttcaatagaataatatagagacaaatttatagaaacacataaatctgggcattttagaaacaagatgacaacatgatttatgctctaaactgggatgcttttaagaaggaaaggaggtaacattagtcatcaggcaaggacatcaagagggattcaagactgtcactaggaaactgctagaatctctagacaatgaacattgagccatttcccaattgttttagcagttctagtacacgtctgcatgatatcttcactacagtgaggcatcccttcttgtagtggatttattctttatgaggtttccttgactcatgtatatacagttcatgcaagtatccccataatgtggtagcaggagaaagaaagatttactcatcccttttcttttggaatgcacaaattaaaatctaaaggtagtaaaagacctttggcaagtatattggcaagtgtagaagcttcctcacatgactggagaggacctgtggctccccagcttttaagccctctgtgctcgatgtacaggatggagcaatacagtgttttcagagcaccgtaagaactgactcatgtcacttaaccacacttttgtacccataaaggtctgcattaaattaccacacaggcttttctactttgggtttaacagccccagtttattgcaccatgtatgcaaggctacaacagtcaagaaaatgctctcaaccttttccagagtccacatacccctcttcatggcagctcatgcatgaaaatgtgggcatcgggagagagagatggaggccatttgtaacgctggtatttcctaaagtgccaactaaacaaagggaaggtcagcagcttgtaaaggaggaagggtgcaagctctggagtggatctgttttcaagcgctagctcaggtatgcatcaggtatggcctgtgtcagggggcaagtccctctgagccccatagtgctcatctgtagaagaaggataatgcaatctcccttaagaggttgtaagaaggatggcagatgacatggatttggagtcttccatctacctagcatattgtaaatagctactgcgactcttccttgcgggtggtgtaataactacaagtaacagatactccaataagtacatggacaggcaggcgatatgcatggaggccattgatttaaaatgattcctgaccctcaaagataataagattagatttacagcacgatatctgaactgcagccatcccacaaggcataggcaactggcaatggctgctgacaggcttgatcaggcctgaatattagaaaagggcatctcattgtgctgtgtcacatgtcacacaactttgctcaacacactttccatccatgtcatctcatcttcaccctagcaagtttaaacttgaataagatatcagccttggacttgtaatgctgaaaagaacttattgttcacaaggtcattctttttaagcatctccccaggtgcttatttggaaaaaaaaaataggctgctgactatgcagtcttgattctattctggctttacagagcttctttttcttgacaaatacttgcattttggtacccacatatacttcattcccaatcctcatttgtctttgttttgcttgttctctgacctctgcttccatttctgaatttccagctgtagcgaatcttgtcagtcgagagagcacctcttgcagaccagtcacacctccaggtactgtgctgtgcatacccttccaaacaggctctcactgtccccaggttggagcccaacaaagtcacgccaccctagctgtgctcaggctgttcagagtcagcacctggtcccaaggagaagcactgagctccccaaagcacctctcttcaggacaagcagaaagaatttctccttgacttaagcacggaggagattttcatcctccaagtaaattatcattaatcattagaaggttcatagttgcattttaaagacctcaagggtctacttaatgcttgagtaacatcatcaatgtatttcaaacaaacagaatttaacattgttaccagaagagttttctcaactagaattataatagctcataaaaaatgatacagttgaaaagacaatgcttgtggatttcaagtgagttcacctccatatgaaatcctggccaaaatctcagagactgcaggacactgtggagttccctgggagaactcagtgggataagtacacatttccaccagagaaggaaagccagctggtctctgagtgttaataaggctacgtggattagatgttcatgctgagttattaagcctcatttaggagttagtttttccaagttcctactcaagtttttcctctgtgtgcaagcacataattccttcaaaactcacaaactcaatttgcacaatattaatttggaaatgtattttcaccttttcatgggtttattgttccccaacttgattgccagtttcttgaaggcaagttttattgcttttctattttaagcatcaaccattaaacatttattatcctgccttacagtaatcatttcaaagttattaacgattaatattttaatgcattaaagctgttaaggtatttctctaaacacataagtttgttttaagagcgactttggcacaggagaaaatatgactttgaaatatattcattaccaaacacataacttaatgttccagattcatccagaatgtcatccaattgattgtactgcctttgagaaatgacaataaataatggctggaaatggggggctaagtgagatgagggctcaaagggaagatgttataaatttttggaccaggttcaatttcaaatatgcatatctgtgtttttgttgctgtttaattctgatatataattaatagaacattctcccatgtttaacattattcacatttctgctatttgtgaagtgtgctaatgtcttactcattcaacaaatatggattaatcctcatctatgtttcagacactgagtaagatgctgagcacataaagcaggcttccacagagcccctgcccttaaggaattcataaaatagtggggaaaacaaagaagtcaactatctacccattgtcttcatctattccagctgctgtaacaaaaaataccataaactcggcagcttataaacaaccaacatttctttctcacagtctggaggctgggaagtctatgatccaggcaccagtagatgtggtgtctggcaagggtttgctttctggttcctagccggcaccttctcactgtgtcctcacaaggtgggaggaatgagggagctctccggggtcttgtttactcgggcacgaatcccattcatgagggactccacctttatgacctaatcagctctcaaatgcctcacctcgtaataccattacattgaaggttcaattttaacctacgacttttgggaggacataaatgttcagaccatagcaccatttaactcattaattagaaaaaatgtccgttgagtgcttactttaatgccagcactgctgtaagcatgtgggacccaggagtgagaaaaagacgttaagtcctggtcattgggaactttcattgtagtggtgggaggaaataacattaatagctgaggctaaaactgaacatggtaagaagagtcaaaagggctagataggagggagctgtgatctgaaataaggtggtgaggcttgggttccattaagaagatggcatttgagcaaagactcaaaaaagatgggacagttggccagatgggttgtctgggggaagagctttccaggcagaacagcgcccagcaaactctagcccatgggccaaatcctacctgctgcccattttgtgaataaagttttattagcacccagtcacactcatgcatccatagactgtggagattttcatactatgatggaaagattgaaaaaatgcaacagtggccatgtggactgcaaagcctaaaatatttattcactggccctttatagaaaagtttgctgagctctgaaaggcaaggaagaaccagaggcactgtgtggcatttcagaggctaaagccaagggagcacatagatgaggacaggaagggaacaggagggccatggcagcactctggctttctctgcaagtaaaatgggggctctcgtaaggttggggcaagagactgaccaagagctccagtagtatgggggaaagtgcaacttgaacagtgtgagaaagggatggaacagacccaccagagactggggaaaatggaaatttaaactaaactaactaggagccagaattagccaggaggcaaaatcaagcaaagtgaggacaaaataatcacaaactgcaaagcaacatggtgaggaaggcagaatgcgcccccgaaactgcacattgctccttaaaggacaccaagcatgcatgcgggaaaaatagcaggagccagggctgtaaaaacaggcagagccagatcatagcggccaggcaagaagaaacaggcagaacccacaaaggcttccagagctcgggccaggcctgctggccctctccaatccagcttgtgctgacagctgacagcacctcccaccatctagagcccctgcagaggtgcagaggatcagggggaagggagtgtgtattcatcagtatataaccaataatgctgttggtgtcataagaaattgcacctggaactgcagtataaaatccaagagacttagcttgctaaaggcaggtttttagaaccataccagatatttatgatgggtttctgcaagatgtggtgggaaggttagaattctggtaggtccttactcagggatctctgtatcccggccagatgtcaccatggaaaagccagtatcatcatttgcctgaagattagttctgaaactctgggtcctggggttgcaaaaggccacagcatgtcatgctctgcccacacattctgatgatgcatgctttgtgcctctgtgctcctcttaggctagactatgagagcactcatttctgccatccttccctgtagtcttttgagatagtaattcagatatagaataagcaacacaagatcgagctcactgctaactcaagcatcagcaatgctcaagagttttagcattgttcaactcaataatgaatcttgacttgctggatcttgcattcttgagacttgcggaggagagaagcgccccttccccagagacataggggcagggagcgatgcacagtggacaaagcagcagttcaagtgaatgcattgtccatagcagtactgtagagagaggaaggaagaaacatgtaaaacagccctctgccctgggcaaagcagacaggagatcaccatccctacctcaggactcatgactctcacaggaaacaagaagacaacgccatctgctaacaatggagatgatatggctgatataggaagcctgagaagtaaacagatttaccagcagtagaagaaagagcattaagattgtcagcagaaagtaaggcgttgtgacttcagatctcaacagttgagtatttcttcctttggacagtgttatagtttaactgtacccatcccccaaccaaaaaaatatgttgaagtcccaacccccaattttcatgaatgtgaccttatctggaaacagggtctctgcagatataatcaagttaagatattccaacatgactggtatccttataaggaaaggctaatttagagagaggcacaggaagatggccatgtgaagatggagacagacataggattgaagctatcataagccaaggagtgcctggggctactagagctagaggaggtaaccatggtttctcccctcaaggacttggagagtgcatggccatgccggcaccttgattttggaccttcagccttcagcattttaagacaatacatttctggtagtttctgatggttatttttatttctgtgggttcagcggtaacattttcttcttcatttctaattgtgtttatttggatcttctttcttttcttctttattagtctagctagtggcctatcttattttttttttcagaaaaccaactccaggattcactaatcttttgaatgagtttttatgtcttgatttccttcagttcagctctgattttgattgtttgttgtctagatgagcactgtggggctcagagagatttgccctttaaacacaggctatatatgatgcatacctgagctaggactttggggttgattaggtcctgtttcttctagctttggggttgatttgttcctgtttctctaattctttccattgtgatggtaacctattaatttgaggtcttcctaactttttgatgtgaacatttagtgctatgcctcttcacactcccttagctgtgtcccagaaattctggtatgttgtatctttgttctcattagtttcaacgcacttctcgatttctgccttaatttcattgtttacacaaaagtcacccaggagcatgttgttcgatttccatgtagttacatggttttttgagtgattttcttagtcttgacttctatgtctattgcactgtgacatgaaagtgtgcttggtatggttttggttcttttgcagcttctgaggattgttttatgtctaattatgtggtcaattttaaagtatgtaccatgtgacaatgagaagaatatatgtcctgtagttttttggtggagagttctgtaaatgtatatcagattcatttggttcaatgttgaattcaggtcctgaatatctttgttaattttgtgcctcaatgatctgtctaatactgtcagtagagtgttaaagtctcacattattattgtgtgtgagtccaagactaattgaaggtctctaaaaacttatgaatctgggtgctactgtgttgtgtgcatatatatttaggatagttatgtcatcttgttgaactgaatcctttaccattatgtaatgcctgtctttgtctttttgatctttgttggtttgaagtcagttttgtctgaaattaaaatggcaaaccctgcctttttctcttttccatttgcttggtagatttttttccatccctttattttgagcctatgggtgtcacttcatgtgacacaggtctcttgaagatagcacactattgagtcttgcctctttctccaccttgccactctgtgccctttaaggggagcatttagcctgtttacattcaagattagtattgatatgcatggatttgatcctatcattatgttgttagctggttattatgttggcttgcttgtgtggttgctttatggtgacactggctgcgtgtttaagggtggttttgtattagctggtagcagtctttcctttctatatttagtgctcctttcaagatctcttgtaaggcaagtttggtggttaacaaagtcactcaacatttgcttatctgaagagaatcttatttctccttcacttaggaagctaagtttagccggatatgaaattcttggttgaagactttttctttatttttaatttaagaatgctgaatataggcccccaatctcttctggcttgtaggatttcagctgagaggtccactgttagcctgatggtgttccatttgtaggtgacctgtcttttctctctagctgccattaacattctttctttcatttcgaccatggaaaatctgatgactgtgtgacttggggatgatcttcttctgtagaatcttgcaggcattctctgtatttcctaaatttgacttttggcctctctagcaaagttggggaagttttcatggatgatatttgaaatatgttttccaatttgtttgctttcttcccctccctctcagggatgccgaggattcatagatttggtgtctttacctctttacataatcccacaattctcaaaggttttgttcattccttttattcttttttctttgactgtcttatttcacagaaccagtcttcaagctctgagattctttcctcagcttggtttattctgctgttaatacttgtgattgcattgtaaaatccttgtattgtgttattcagctctgtcagacctgtgaagttcttttttatatgggctattccttccttcagcttctgtatcactttattataatccttattttccttggattgcattttgctgtccttctaaatctctaacttcattcctatccatattctcacttataaatgagaggtaaatgaagagaacttatgaacacaaagaaggaaacaaagaacactggggtctacttgagggtagaggcggggaggagggagaagagaagaaaatataactattgggtactggacttaactcctgggtaataaaataatctgtacaacaaaaccccatgacatgggtttacctttgtaacaaaccttcacatatcctgcagaaccgaaaagttaaaaattaaataaatattttttaaaaaaagagaataaatttctattgttttgagctaccctgtttgtggtactttgttttagcaacctaggaaacaagcacaggcactgtccaaaatgtcactgaaggtatggcttgatgaaacaattcattggtggctgtctgctggctgcctggaagtttgggcagaacagtgcccagtatatgagcacgcagtaaaagttagtgactgctctactgggcgtttcatcggtttgtccaataactattggaaacatgcagagggactacctaaatgcataagcaaattgtctcatacacaatttaatcacagttaatcggaatgcaaaaattttgctgactaaggttagcagctgctataccctcccaacttctcctgctgagacaattttctttcctcaacacaaaaatgttgcaaaaaactgaaaagcatgcaaaacaaagaagtgagttttgttcatcattatatgtaagcagctgctagctgagtggtggccttctagaggatccaagtcctgctaatgttctggaagtcacaagattagatggtgatggatgtagcttgaatgtgccagtaaagatgaggaaagaggatgttggaaggtgtcagtaattcaagaaccacaggcccaaataatcactcatttattcagtcaacaaacatgtattaactccctactacatctcagacattgtatcggactttggggagttcacagtagctccccttatttgtggagtactgactatgtgccagacactaatacttatcatcttcgttgtcccactttattctcacaatgtccaggtcaggtagtcagtgatctgcagtatgcagatgaggaagccaagaaccagtaagacaaatttatgccccaagggccaagcctcagatcgtctaactccaaagcttctactgtctatctcaaagcttcacaccacatattactggctattctgtggagagtgggtcagagaggggctagtgcagcatttcagatgaggaaggcttgaacaagcacagaagtggaggaataagaagaaagactcaggtctgggagccactctaaaagtggtctctgcaggacctggggttgagtgggtctggaaagagagggaaggagttggctgagatttgcaggtgtctggctcagatgagaggtgaaacatggagcctgctctgggctgagttttgtctcccaaaacttatgttaaggtcccagcccccagtactccagaatgtaactatactcaaaaacagggtcttcaagtgggtaattaggttaaaatgaggtcattggagtgggctttaatccaatatgactgctgtccttataagaataggaaattaggcaacaggcatggacagagggaagaccatgtttagaagatatagggagaagatgacatctacaagccaaggagagaggcctcaggagacaccaatcctgctgacagcttccttttggactttcagcctccagaagtttgggcaaataaatgtctgctgtttaagcacccaggctgtgatactttgtcatggcatccctagaaaactaatacagagcccatacccaagattgaaaaacaaagaaatgaacatgaatggggtaggctgagctgaaagtactgcaaggagcatccagctggaagtgaacatcgcatctgtggactaagtcggagctgagaccagatctgtgaatggtcctcagtaggcgggcatggtgtgagtcaggggagttaaaattttggaatagaaaaaaaaatgtgattacatatacaccatggactactactcagctataaaaaggaacaaaataatgtattttgcatcaacttggaaggagctggagatcattattccaaggggagtaattcaagaatggaaaaccaaatatcgtgtgttcttacttgtaagtgggagctaagctatgaggatgcaaaggcataagaatgatacaatggtcttttgggacttgtgggaaaggttggcaggggagtgggggataaaagactatatacagggtacggtgtacactgttcaggtgaagggtgcactacaatctcagaaattaccactaaataacttatccatgtaaccaaaaaccacctgtgccccagaaattattggaatagaaaactaagaaaaaacaacaaaaaaacttcaggatagatgggaatccaagtaaccaaaaaccacctgtgccccagaaattattgaaatagaaaactaagaaaaaacaacaaaaaaacttcagaatagatgggaatccaagtaaccaaaaaccacctgtgccccagaaattattgaaatagaaaactaagaaaaaaacaacaaaaaaaatttggtatagatgggaatccaagaaaagcgtgtggaatgagaagagtgggcagaaggaagggattgaggacagaattcccagggataagcaaagcttaaagaccagcggaaggaaaagagtcaaggacagggcagacgctcaagccacagcgtgcactacctaagtatggtacagcataaactttctgtaaaagaaacttcgaggcaacaatgtcatccttccagtaagatagttaaggtaatggctggaaatcggtcctcaaataatgtaactagacactgtgggactggggagaaccacagcagcgccgcatggtgggatgcaaagggcagagaagatgagaattgcctgaagatgggagtttaagactgccgtcctcaacaaagtcagccaataatggagggcaactgatgggacagggacttaccctccactcctcctgtttctgctgagagaaaattgccactgcatggccaccaaagcaggaagacctacgccttcaccaccccattgtagcctccttccgcaacaagtccaactctcaaattttattttgctcacttggttgaaaactcaagagagaagtctgagagcatcatttaatgggtccttaaaatcaccatgtgaaaggggagcattcttggacacggcagaactaagggtgtttgtttttagcttgttgcggtttctttgtttttgtcttacttaagagaaaaggcatccgaacattttctttttttttttttttttttttgagacggagtctcgctgtgtcacccaggctggagtgcagtggcgcgatctcggcttactgcaagctccgcctcccgggttcacaccattctcctgcctcagcctcccgagtagctgggactacaggcgcccaccaccacgcccggctaattttttctatttttagtagagacggggtttcacagtgttagccaggatggtctcgatctcctgacctcgtgatccgcccgcctcggcctcccaaagtgctgggattacaggcgtgagccaccgcgcctggccccccgaacatttttctgaaatcatgagtcatcattagaaaggaagaaatttgaggttatggtgaaaagaaagataatggataaggcagaaatattgtccaaaaaacgaaaattactccagaacacagcagaaagaatcagctacagaccccgagtgacaagaagaggtaagtttgagggcttactgggaaaaaccctttagaacctaacatttctctgtaaagtaggaggaaagataaacccattgagaatccctgggagaggctgggagaggactggagtgggggtagttgcaaggggagaggacaggaactggggtgcttagaccattacggagctgacctgagggcctcactgaagacagaggctccaccttttctgttgccctttctaccacaggacgattctcactagcaccccagtgtttaagagacacagaagccaaggggtggccccccctggggctggatttggtgggagtcagtgcaggcgggcaggagtggaaggagaactaaaggaggaagacctgagacaagggcatctggcaaagaacagatgggatgcaaagcctgtgtcccaattaggccaggaaggataaatgtccctgtgttcaggctcagcagggggtggaagcagaacctagtgtggttagagaccagaatccatcctggatggaggatcaatcagagaagcgaatcagggtcaactaggagtggaaatagtatctcagggctcagcagtagcagaaagtgccctaacaaaacacaggagaggtatgaagacaacacttcatatgcaataactcagggtcctcaggcagggctcttggttttctatcctaggagagagggtcttcccaatgtaggccagggaaggagtgtgggggagggcggtggaaatgctgctttcctgagaaatgcaggctattcattgtcatgcaaattgtgctgcccttgtggcctgagtggtagagccaccgtattgacctctgaattactttcagtgtctgcagttatcagatcttagaaatgaacagcagaatgttttaggaatcggaaacattaatgcctttgtaaatcaaataacaatgttatgcctgagaagactgtgataaacactgttttagctcttccattgcctggatggcaacacatgactctccaatggaaaaggagaattcacagatgctgacaaccaggacgctgaccgatactgaccacctgatcagctggtggtcactcagtcacatgtaagaaggcagctagtgtttgtaactcatactatgacctgaattgtttttccaggatattcttaaagtgtcactttgggaaaagagctttttactttgcttctggcaaatgctaattacaaagcttttattgggatagggattcttgatttttaagtggaaacttccttggccagtcagaatcaacaaacatatggaaagaacaacttgaagctgcacagatgaaagtttcagggccaaaaggggaccatccacatagaatcaactgattcggttgaagtcagttcaacagaaatgatgttaatgggagaattctagttagtgcttcagtttgggaaaacaattcatgtttccctttggaagcaatagagtcatttagtttacttgagaaagttaatgacgaggacatcctttttttcctacaggacagtcttttaaaggcaatctctgatgattaggttgactgtattatttggcaaaatacttgcattgaatatatgtacacgtatccatggttttgcatatatgatgagtctaaagcagtggttctcaactagagttaattcccccctcccagggggtactgaaaaattgctgaaaacattttttgttgttacaactgggcagaggaggatgctactggcatataatgactataggttgaaaatgctgctagacatcctactatgccaaggacaagacccaccccccagtcccacaactaagacaatttggcccaaaacatcactagtgctgaggttgagaaactctggtctacataattagctgatatgtagcaaaagtctactaactctcaagatttcacttttgtacaaactatcaaataaatgcttggggcaatggattacacatggtacatatacattgtctttgtaggtgtatgtgtatgtgcgtgtgtgtgtgagaccacactcacacatgaatgcacagatatacagagggctgcatttcagctgacacacatcagggctttgtacacagcgaacctcaatttggatggttgtcaccatcttctgattgctcagtaagcaagtgaccaagttctggcccagaactgaaagaagccttctaagggtttctggtttctttaaaaataaatgcatggatgaaaaggggagagggatgtggctcttcttcgagtggatgttgccacatgtggatgcaatacctgaatttgcagcaacaattttgcaaccacaagcagaggtggcctgagggcccatctgccagactgtggatggcagagactgcagtgaatactcgcctccttattaactgagccactgaatgaataaaccctgaagatgcctactactaacttctaagtatgtgagttgatacattttttacatttttaattgtcatactttttggagttacctatagacaaacacattcttttatacagttgctgaaaattacatgccatgttagtaatttccatttctagacacataaaatggaagttaagaagtaatgcacaggagtctacacatgacaagctgtcaaattttctagacattaaacaacaatataaaaaaaaacagcaagtttctataagtggtcatatcaacattagccatattatcatggttagagtgttgcgaatatcacttctcttccaaatactaaatagccatatgatatcctgtttatcattagtcctgaacaagcgacactttgatttctttagaagatgaagaattcatttttatttagagtgttgtagtttgcttttgagcaccaaatcaccaggaatcaaagacaaatgaggtgagaaagagggagtgacggaaggcttaccattgagccatttggagttgtactgcgccgtgcggagaggaggtaaaatgcctaggcttcggtaaatggcaggatcacgtcctggaaaatccatggctgtagcagcatagagctccccaccagctgtgaggagcgctgtggaattgtgctggggactgtagggacagcgggccatgccactgatctgatcatggatctcagtcaggttgctcaactgtgggggaggatgagagggaaagcagttatctctgcacaagcccctttagtgatgcttatggtcacacccaccatcatcacagtgacgcttgtgcaacagcctctcgggggcccatggggcaagatgaccaacttttacattccaactgatgtaaagagcctactctgctcatggtaagacagtccatcaatcagtttctttctcatcactttagagttactgaaccttgtaccactgaatactcacaaaataagaaataagatcattgtatatatgcctttgatttataatgcacaagtattgcatacttttccactttaatataaaaaccagtgtcaatatttacagaaataggatcacaataaagaattatgtataattgcctgggcacagtggctcacgcctataatcccagcactttgggaggctgaagcgggcagatcacgaggtcaggagatcaagaccatcctggctaacacggtgaaaccccatctctactaaaaaaaaaaaaaaaaaaaaaaaaaaaaaattagccacgcatggtggcatgcacctgtagtcccagctactcgggaggctgaggcaggagaatcgcttgaacccaggaggcggatgttgcagcgagccaaaatcgtgccgctgcattccagcctgggaggcagagcgagactctgtctcaaaaaaaaaaaaaaaaaattatgtataattctatcaatataagtgaagcaaaatataatgaatagccccaaaaaatgtgttcacaagtaaggatgtgtggatattcaacactatgtggcccacatttccaacactttctttcttttttttcagttttcagagagatagctaagcgtcttggagtcatttcgtatgaatccagcttcccaaatgctggattcccaaccagccattgaatgagaaaagctcttgggtactggtggaatctttgctcaatttggttcttggttctcgcctgagaggtattggagcagaagggtcaggcccggtaggtacaggcacactgcttgctctgctatgagatgtgtacctgggtaagttccttcagctctttatgtctcaggttcttctttcataaaagggggccccaaagagtagcgatcttgtggggcagatgttgaggactgaaccatggcactggtgaaagcgcccagggcagggtgcagcacctagagagctccctgagtttcacaccccttatcatccaactcctccctttatttccaataactgaatgctaacctgaaatcatgaacagtaaaagcagatggtcaattaaggtcttgaggaaagttgtgcaaccagggaatgaacatatttcttcatgatattcccagaggaaggttgcatttataccctgaattaggaagattccacgtgtgttctactgaccctgccatgctactgctatggtgtgtgcagctgaaaattactctgtcaatgattgccaggttaaagacaagaaagaggatcagttataactggactttgcctagggtgcaatttcttagtttgcttatttttttttacatacttcttatccaatttgtaggctaattttttcttcccttggattgtgattttagaccattttaataattttaaataaatataaataacagtaacagtatctctaccataaagcagaataagacaaaaaagaatatgtttaggattaatgtttaaagtcactggtggaaaaaaatgctggttggaatagtttagaaacatatttaagtttaattatacaagttataattatttccagttatttatctaattgatggtcctgattagaaatatatcaataaatcaaatatttattcaatttgacaaaaagtgctttagaattgaacagcaacaccttggtgtatagaaattcatttaaaactagtatttttacacaatgttttgcctcttctgatattaaattcttttgaggcacaaaaagaagccataccgagcggttggtgcagacaggcgtgaatgcattggtcccacaggtgaataaccggtcgccacccaccagaagcacccggatgtagttctgacattcctcctgagggaaaataaataaattaattaaaaatatatatatatatgtataatgataaacatgctaacaaagtctgagcacaagaagaatggtgagaaggaatacattttatctaataaatatgtaagccattaataaaatgtaaaccattaaaacaacaaataaacctttcagatattgaccaaaaaataacaacagagctattaaacaatttgatttttatcaaataaatttaattgctgtatctgcaccttgtttgataaaaaatatgaagataaatacatgttcaattaaattctcaaagcatgcatctaattttgacagaaatgatttcattttgaattgtatctgatagtagcacaaatgctaaatggccttggacgggtattaggaaaataaataaaaggaacctattagatgtcgctcgggaagcagtgccttggaaaacttcctcagactttgagaaaatgctgcaagcgctttttgatcagaaggtcacatgagaaactctgtacacaaactggagcaaattttactttatgggatccaactgcatattttaaatacaaagcaagtatctatatgaatttttttttttttttttgagacggagtctcgctctgtcgcccaggctggagtgccgtggtgcaaattcggctcactgcaagctctgcctcccaggttcatgccattctcctgcctcagcctcccgagtagctgggactacaggtgcccgccaccacgcccggccaattttttgtatttttagtagagacagggtttcaccatgttagtcaggatggtcttgatctcttgacctcgtgatctacctgcctcggcctcccaaagtgctgggattacaggcgtgagccgccacgcccggcctgtataggcatttttaattcattgattgaaaagtgaaaatatgcttaatgaggacaagatgttcgaaacatttgggacaaaaccctaggctgagggatactccaagaatggagtactttttgtggttgcaaagtgttcttagaaaaccctgggtatggtcatagcagtgatggacatgtgagctggagagctcctcacttattcagcaagcattcactgagtagctcctctttggtagccactgggttagaagtctcaatccaggctcctggcagaaaaatacaggatcatgacaattaccacagagctgtccatgcactgtaatgaggacacacagaggaatagcatattacgtagctccaaaggaacagggaagggaagaggtgtagagaggcttcctgaaggagctgacaactaagtgttaaataaagtgtaaggtttagtgaggcttcctggagggggtgcttgtaggacacctgttggactttactgagcaaaggagggaaaagacactccactcaagaggagcagactgtgtcaaagtgtcgtggctagagaaagcatggcgctctcattgtgtacagaggagctcacatagaagccgaggagcctgaaacaggccaagtgtgcccaggtagtgagttcacatgttactctgaatgtgaaaggagccattacatgttttgactgcgtgaagtattgatgagctctcatgttttatcactgaagaagcactcagaaaccaatgtgcaggataagctgaagagagaagcctggagtcaggaagccaaggaggaagtcacttccataactcaggctcttgtcatttcatgcctagaccaaggtagtaggtgtgaaaggacaaagccagaatagtgagtcaattgcacgccatggcgaatgaatgacgcacgaggcatgaaagatgctgcatgataacatgatgatttgaatcacatcatgctggaaatcaggggaatctggatgtaatggtatagctcatcttctcttcaaccaaatggacccccactctagatgaaagtgttaatttcccataacccagtctactgcatagcatcgagacagcggaaatgcatagtgctaatttctgtattttctttactagagacagggttctgtcatgctgcccaggctggtctcgaactcctgggctcaaatgatcctcccaccttggcctctcaaagtgctgggattacaggtgcgagcaccactcctggctcagattggcttctaaatgtaaagtgaaataccaagggtggattatcctcctaacattattcctaacagtaatagtaaccacttatcattggaagctgaactgaggaagatggaaaacaaccacaaagacctaagtagacttcagaagaattaccaaatgctcgtaaacagtagacagtgaatctggtaactgagaaaggtacaccagaggtgggaggcttgtcttgttttgttctcttttgtttttattcctggggaagggtcaggagagttctaaagggaaagaacaaaacaaaagacttcaaagaaccacacagtacttccttcccaggctgaagagaacacaggagggccagggaagaaactagaggggtacgggagcctataaaggcaggcagagtgaggataaaagaaggaagccgatgcctgtcagaggagacccacaaagacatcttccagaacacagggctgagcaagctgatggacttaatggatgacacagacatattaatgacaccatcataaggactgggatggaaaattacaaacagaatagaagggtgaggttttgtttgttttttgatgctgcttttagaactcttttaaaagcaaggcaagatgtaataaaactttttcctttaaaaaaaaaaaaaaagcaagagcttgccccaaggtaaaccacaaacaacatgggcaagggtaatttgttccaggagaatcatctggattgaaaagatgtgatttcacagcagagttctacagccctggtgaagagaaagcaagggcctccagtcaattatggaaaggagaataaccaagatatcaaatatggtgtttacgttaatttcccaaaggaagaacaaagtgcaaataagactgtaggttgctttcttttgtttttgtttttgttttttgagacaagggttcactctgttgcccaggctggagtgcagtggcacaatcgtggttcactgcagcctcgaccacttgggctcaagtgatcctctcacctcagtctcccaagtagctcggattacacgtgtatgccaccacccctggctatttttttcttttttttttttttttttttttgtagggtcaaggactcattatgttgcccaggctggtctcgaattcctgggttcaagggatcctcctgccttgtcctcccaaagtgctgggattgcaggcatgagccacagtgccctgcaactataggttaacattcctgaagaccactctcaaggttgacgaagaaccagcatgttggtcagaatgtgtgataaccatggtaaccatggtgcagcagtgtgccagggaggggcagtgcaaacccagctggtagtgtaagaatatcagagaaaaagtaaatgaggaaagggacagaattatttcaattagggcagagaatgaaagagcacgttctgatcattaagaccacgtgagaatacatgaagacactggctctattattggcgatgagccacatccccatgtgtcactggtgttcttcgcagaacggagtgagtgtgtggaaaaaaaggaggaagatgtcagggatccagatgatcaggcaaggaggtctgtgcagaatttttataaaatgatggagggtggccccagccctatggaacccagaggagcctgtggcaatcaggagctaatgaaggagggtagtagtgtagttggccccagccttaactagaggtctgagttatcaccaataacagtaggtgtgctcattcactgagtcctacaggagcaacgagtggaggtgggtggtattcgagtttcttcttaactgtcaagagcataactcagtcacccaactggctaagggcatctcacgtacttcccgttcttactcccttaaaggcatcctcatgtttaattcacagattgtgaattccagatgtgaattccaaacaaattcatttaaaataataaatgttttgaaaagagagattgggacaagttcaactgaaacagaatgtgaaaacacagggaaaaaaaagaaagtagaagtatttagcttttgagcagaagataaatttgggaattggacagtcaatactgtgaataaaaggaaatgagtggctgggcacggtggttccatgcctgtaatcccagcactttggaacgccaaggcaggcagatcacctgaggtcaggagttcgagaccagcctggccaacatgaaaccccatgcctactaaaaatacaaaagttagccaagtgtggtaatgcatgcctgtaaccccagctactactcaagagactgaagtgggagaatttcttgaactcaggaggcggagcttacagtgagccaagatggcgccactgcactccagcctgagtacagagcaagactccatctcaaaaaaaaaaaaaaaaaaaaaaaaaaaatggaaatgagtaaccgttccaggctgtgtaataattagtctcctcttgatggtgttttcaaaactcaaattctcttgcagatccactggcaacgcactttgccaatctctgttacaaacgtggcctttccatgggttacctgaacttgcttgaagtactgcttggagtcacaatgtagaggtagagtcacaatgtagaagtccctttaggagattcttttaaaggtttctcttataaatcagcatacttaaatgtctatgattttccttttgtcatctaagaattttttcttctagcccatttctgtaacttgaaaataggtgaagaggatttaatgaattctgattttccaagaagtcacagtgcacatctccaaggcctctagcagcttgctgccacaaggcttctagggttgataatgagagtcatctatctacattttgatcacagcacttgaacattaaaatgacccatgtgggcctgtgatccacagacgtatcaacctgtccttgacttcaaggcaattgatagccgaggagcatggttgctgactcatagaaagggcttttacatggagactggccaatacccacttggtctcaaggacacaaggccccagccccagcagagaaaacatgttttagggctgttttcttaatgaattaattggttttgtcatatagcatttcatgatttttttttaaacaggtatgttctgtggatccctcaggtatctcttcagcaatacccagcccgtcgcccagcccactaattttagggaggaaaggtaagggttagaaggctacaggctttatgttaatcatagtgctcccagtgaaatcaatgtgtcctcttcataatgtgttatctttgtcagcatcaaagtgctgaagaagagcaatttacaggaattgcatgagcctttcaaagttgaacccacatcaacctaaatcatgattacctggtgactcttgcaaaaccatacctaaccaaatcagatgtatgtgtgtatgtgtgtgtgtataaaggttgtatctatataattgtatacatgtattacttgtgaatatatgcacatgcaaatcacagatgcaatatgtagagataaacactcatatacatatattacgtgctatgtaatgtacagtgtattgatatataaaatatactatactgtatatatgtacatactctattttcaactgagctgacttcatgggaaacctttttggatacctcaattaaaaaaaataaaattaggtgtgcataatctaattttaacctaatgttagtatttaacctaaagtaccctcaatttttaaagcaattacataaaataaaagcagggctacaatgtgtcccatgtattgattaactcacagctttcaaaatattggcacttaggtacaaaatgtcaagatccagccctacaccagcaggcacttaggtagtatggtgtcatgagtttcttctcctgttcactaggagtttacctctttaccagcataatttgacaacttggtaaacaggaccacaggatatgacagggagaacaatatacatagctctggattctaatcaaaaccctcccactaactagcaaaataattctaggaacttggtgtcaaaaatcctgaaatgagatcatgaacaaaaacttttgaaaatcacaaagtgtaatagaagcatacagcagctctttcattcccataataatcagctgtgtttcctttgtaaagttcctaaatgtcagagtgggaggaacgtcagttcagacattatagcccaacacacacaaggaactcttgttaggtcgtgagagaattgactatttgtgtttaaaataatatttgtgtaaaagatacttaagtagttatagaattcagtttctataatgctatgtccagaagaactaaatacaacaggttttattataagtttttgaatccataaaaacagattccccacccccactttttttcccccatggaatatttaagccattgcaggcaaaggcactccctctttcccaagggagctgaacattttctaaataaaatagaattcaaactttacaagggcttggcagcttcagtacctaccttcttttcaaacctggcccaaataaaaaatctggataacttctcttgaccctaattccctaaattgtacttttaatggattatatgtgaaatcatatctgtgtctggatacagacatcccagggaaacaaggggaaatccatcatctctactctcctccactctgcagcaagctgaggaatgctcccatcagaacagcaagtgggcacaggcagtgtcctccctgcacacccagccacctccttccatgcatgcattccagctcagctcagcagctaaatgcattatgtgcagaagcacagaccacttttctcagagtaggaaaaaaaaaaaacaacttcagtttaaattgctggcattcttctcatttttgagatgtcacattttgcattattctttttatttcagggagaagggaaactttgtaattctgttctcataagaacttcagcacaagcaaaactacaaaacagctgaattagccttctaagctcatgaccactaagaaaagtcttcattccattcacccaaagagacgttacctatcagtcaaattgactgtgagaatgttctctgaattggctcctaggaactgtcaaaatggggaaatgtgggttgtctgaattctgagttcagggggcagtccttcggaggctgcatttggtccagttgcccctgttcataggggctgccttgtttctttcccttctctgtcccaggagctgggcttggtcagccagcttggtcacatcatggtcattgttcagttactatgttaagaaagcaagagagatgccaaataagaaagaggaacttataaaggtgggtgaagagccctctcctctcaccacccatgaaccagcccagtgctgtctagaccaacatgtttgtaaagctactgcatcatttttgtacacaggaatttccaatgcacacagctctgctacataaactgagctgtacttcgaagcaacagaagttatttaaactgtctgtgaatttatcaatatacttaaggcaacctaaaagaacgtgtgatttatctttctcagagtacgtggtgcttgacactcatcttcatctgtcttactatattagtgttaaaaaatccattcacaaatgcggtttgagtcaattaataattactaagatttcccattatttttaatccattaaaacccaaagcatgtgaaacataaaggtttgattttacttgaaaatatttgtttccctcatttgctttctgtgtatcaagaaaattcaattaagtgtagtaacgattggtctcctccgtgaatcgagggtatattacctatcggtcccaaaagatggccttttcctaatacttctctgggttcaatttacttaagttctaagcaccaaacaaccaatgatcacggcttaaggcaaaacgtgggctagttcttcttcagcagaagcaatttttcaccccaagtagaaataatctattagcaaaaggcaaccacatagattctttgtaaattatggacttccagactatgaggaggaaaaacccctcgctacatgatggaatctgatgctttgctttagtaggacaaggagtataaggagactgaagctcataaaggggaagggagttaactgttaatttttaaacgtctttgtaacaaatatatacatgtaatcaagatgaaatatgagaggactctagggagcataaaaatcaaaataaacaatgcaaaagtgacaaataaatttgccattttggaaattaaagcagggattcccgaccaggtcaatgtctggcaatgtgtttcctgccatgtatggaatagctgccatgtcaaagcataatctggccccaaatatcaataatgatgaagatgagaaaccctaaattaaagttcactaccctggtatgggcttctcatgttcattcagtcattcagtggaacatctttaaacgctcaccgtgggctgggagtgttaagatcggacgaggaaatagcactgggacctgggagagggaaggagggtggggcccctcaggtctgggctatcagctaaacattttcagaacagacactgtgacaagtgtgcatcaacaatatctgctgctaggttgctcaaatctgaatagtgcttattgatgtgtccatgagacccagaaagaaagaaaaagaggagaggaaagagtcaaagtaccagaaggaagataaagacaagaagaaagagttgagaaaaagcaagagggagagctaggtcactgtattagtctgttctcacactgctaatacctgagactgggtaattttaaaggaaagaggcttaatggactcatagttccacatgactggggagtccacacaatcatagcagcaaatgaaggggaagcaagacacgtcttacatggcagcaggcaagagagcttgtgcaggggaactcccctttaaaaaccatcaggtcttgtgagacttattcagtatcatgagaatagcacagggaagccccacccccacaattcaattaccttcccccaggtctcttctagcacacatgggaattatggaagctataattcaagatggagtttggtggggacacagccaaaccatatcaggcatcacacagagcaacccctgggaggcattgatatccccaggcaaggcccacggcaggccttgagagcatggaacagtggtgcttgcatcagtgaatcttactagttgaaataaagaaagccatctttccacccctcacttcatgtaagtctgactccaggtcccatctcattccttggcacaggtggtcttatttaaaggactgtgctctgaccagtgaagtggggccgagggccgagccacacaacccccacattgagactcaaacaccacagggaggaaaaaggaaactatttagaaatcacctcttcaaaagtcctatacatcatttctacaaactcaacaagaaggttataggggtccccgatgtgtgggctttagattatttatttattttggggagcatttgaggatatcacattcgaattctttgacaattggagtacctttaaatctccttatatctctgatgatttaactcagaggccttttctgcggttaaatatcttccagaaaatacccttcatcaattcctgctttatttcccccttgtctccaagtgtttccctggctaagactgcattttcctccttctcttcttcctactcctttattcagggttgggaaaccccataactaagctggctgacacttgcctcagtgtctgactcccacagcgattcagttaaagggcagggaagcagacaatgaaattgggtaaaaaaaaggtacataacactcttttataaatacagaagggggaggatcttttgccagtgctctctgcatttgctatatttttttccccaaactattggtcctaggaccaactttgcatagcaagccctcttttctactctgtgtataactgctgtcttctgtaacccaaagcataattcaccattggaagtctgtgctccaatataaagtaagaagatcactaacagaataatacacagtgagcctgttcacaagctgcagaagaatttcctcaagttgatcatgaataattttctcaaagacacatagtcttcctggaaaggcaaagaatcacgcatctttttgagccagagaaacatttgaaagaagcctgcaacatgtacaattgctcaagaaacacatttccaaccttagctataaactgcacattctataggaacatgggatgtagattttcgtatgaaaagagagtttattataaagaatatgttaagataaagaatctatcacaaataatattttatgtaataaatttatttgtcatatcattactttctagatttagctgtaaagtaagaaaggaggaatttaaaatatcttaaaaattcaggcccatattttttccagcgctatcaatcaattaatttcttatcttagtctaatgacagaaagggcaaattagctctgatcttcttatgttctgaatcctttttggaaatgattgattgctggggttaattttaatttagtattaaaaacttgagaatataccgtatacatattttgaatcttgcttttttcactttacatggcaccgtaatcaggaatactcttcatatcaacatgctttatatagtgtagagtccttcaagacagggtgatggctgctcataattgcattcttcttacctttgatttgcctttgctgtaacaggcctttttggtagcttcatcacactcccattccacagcctgtagaaaacaccaaaacaatagcagtcatggttttgactaaataaaagggaaaatataaacaaggtaacaaggcactggtaaccagattaggaaatatggctgcatcctggcaccaacattttcatactcatagaatttacaccaaatacatgaaatttagtcatgggcttagatttagctctaatattgaagcataaggaccttcccccttactatttgcttttgggtagtaatgatgggatgcttagatctagtcactgttagaaaggaacaatgagttggtgactatagcactgatggtagaaatgatcacttcagtgaaactatggaatagacccagacgaggcttaagggagaggccttgagacaagataatttaaatattaattttaacatttttattttattcaaataatatgtcatttatcaatattcatagataatgaaggatgattttgcatatccttactaccaagatatacctgtaaatgataatcaatcaatagatagctcatgcaaagaacatagctaggatttttccccagtagcagtcattttcatactattattagctctgactaaatgtttagagccacagcttttaaatattttttctcagaatttccaaatctcacttatgctgattaatttgctatgtgtgcttccacgtctgatgctaactcacaaatgaaatgtgtgattagtgaagaaaacagacagggcttgctttacagaaaggatgcctacaggcatccatggcctagctctcgtgaatagttttttgcgcaaattgaggcacctgggctttttttttttctcttttctatcattgtatagagtgtgaacttttatagggtaaaaatatttttttcattctccatacctgttatcagaattattattttctattttactattaaaattggatttctgaaggaacagggatgtgcggtaattcaatcattaacagaaagacattttgagatagagacttttttctgttaatttggactaatgtcaaataataaactaaaccaaaagcaacctagtgtcaaatcatatgaaggaaaataatggcttcacccttattttttagtaagaaatgttttctttctaattatccaaacttgggagaataacaaagtcaggctaacaccattctctaatatcttctgccttccaaagaatgttacataacagagattaaatcatacaacactgcatcttgtataatttatgttacttggcaaatatgagtccataagaaaagtattctagaaagaaccacttcagtgtctttgaaaccaaaacaatgctataactgttttcccttgtgcagacttgaagatttttgtcagtgtcaacatctgataagagaatttgttaattccttctgtgctgtttccctgttcataatgtttgatggtaacaatacagtcatagctaatcagcatctgatgcaaacacatgatttgaattccataccaggatgacaaatattttcatgaaaagcaatgacacctccagagaaaacagcctcccatacagttgcataactatatccccatgaagtacagataaaataaatgaaaataaatgtgttgttgttcatctgatttgacctttagtatattcctttcttagatctctttacaaaatattactcagtttttttgtatttaagtagatatccacgtcttggcctttacttaaacttaaaacagtattgaggattgattaaaacagtattgaggactgaaagaatatgatatattctttcagcagagtaaaactcattataactttgattgtgtattgccagaggtttcagtattacatatcaccaagaggaactggtgttacacaattactaggaaaactatacagtgaaatactttagataaagagtcattcacggtggctttcattggtctagtgattttgttaaaagttaaataataatgttctcttctataaacatgaaagctataaagagaaggattagtcccagggctaaggaagaagaatatttaccaaatgccatcaaaattgttcagatcctgcggctgaaatggcaaacaaacagcttcacaagtctacctaatgcccaaatagcctttgcattttcaagataaatattggccaaagattgaaagggaaaataagagaagaaagaatgtgagagttttaaaaaatatttcattatttttatccagcataccaaaaaatagcaactgctcttacaagtttattagaccaataataaatatgacaaatcttacagattttctgaagatagtgattagaaagaaaaaaaattaatttcctaaggcattttattacagcctcactagcttgcctataatattcaaatccagaattaattaaagaccatgattgtacagcttttctgttcactttctacctgaatagagaacaggataaagggaaattttatattaagaatggaactttacttattccagaagacagcaggaatatatacatattattggatagcacagaatttgaaaaggaatagaatggagaaaagtggcttttccagattatactagaatgggatgctccagattcatcccatagtgtcctcctattcactaggtcagctagactttgcctatttcatcacttgacagacatgaaattaaaaaaaaaaatccatcagagacaaataagagtatcaatgtacctcctctctgtgggttcttatttctcacagtgacgcatttttctgtttgaaattaggctgtttgtttaacctggtcacaacttccttattcttctagatccattctaatgaaccaaatacctcttaatcaagccttctctttcatttctcagtgaaaatttttattatttcatgtatcatgattatagaacaagtctcactactgatttgagaagccacgtgtccacttgtattcaaaagatgtttttccactaacccaaacctatctttacaatagtcaaaacaagtgctaaagcattctacatttcagatctcaacccaacattcatagtctcatttcctgagtctcccttttaaaaatatttaatttttgtcatcttttgtctttttctatttcaggatagcccagtagagaaaagaaatatttctactctaggctattcaatattttgtctgcattatatatttcagcagcagacatatagcagtaatattgtggttacttgaatattcaaagattagatacagtaggcagtgagtttgaaacacctacattttaaaagacacaacgattcctgtttgcagtaagtttttttctgtaaatacatacaaataatacctgtactaaggaacaactcacagaagttttgctttatgcaaatacattaattatctcctttatttaacaaatattcattaagtacctaccaaacagaagacactcttctatgtgactgacagaaggaaaaacagacatagagatacacatcagatattaatttacaatacagcataagtgtattccatcagcctagacagaattatgttaaatctgaggagtcaacagtgttcattttcattgttatagtagccatatgcacgttaatctcaggtccagtgacacactctaacttataatatcattagctttcaggatgtgacaaacatacaaagagagctacaaaaaaaaaaaaaaaaaagaagaggcttatggaaaacccattttatatctgcataaatcctgggtatgcaacaaagcccccattgtttcaaggtacagcatccattggaccgtgttgcacacagacatactacggttaggataaatggagctgtgatctcaagagtaaatcagatagagaaaagaaaaagagattggctctttttatgtatgtgttacatacatataaatccacagttctcagaagtatataaacaaagctgtgtattatcacactccaccgccagataagttaattagatagggaccagcaaaggcagacacttcataaaaatgaagagaacaacattctaggcaaatgggctactactctttcagcagatggctttgctaattagatactggcaaaagataacattaaacaaaactagtttaattacacaacgccaaaaattaacaaccacctgagggctttcttttttcatatgtttacattcatattcttatgtcatgtattctgcgatgcgctgggaaatgttacattgccatggcaattataaacaaatcgtcagggtatgcaagactatatctttgttcaaaactgaaacaaatgcaaatgagttggaactagaaacaactgtgatttgacttgaataaaatgtcaacctataacagtaactttgagagaggacatctttgctaattataataccttcatggtcacacgtgtcagggtcacacaagtgtcacttgagctagaatggcgtgcattgaacgaaaaaaggcagtaaacatttcagtcaatttggaaggatttgttcgatgttcctctgcctttacttcctagtggatattcaatgtgtttgttattttttcacattaattttcagtatactttcatttccgtccatgtcaaatacaagcaagtacaattataacctcaaaatcaaaagactagccaaacatcttatgttctcactggtatgtgggagctaagctatgagtatgcaaaggcaaaagaatgatacactagactttgaggacttatggggaagagtgggagcggggcaaggcataaaagacaaccaacgtggtgcagtgtatactgctcgggcgatgggtgcaccaggatctcacaaatctccactgaagaacttactcatgtaaccacataccttctctaccccaataacatatgggaaaataaatttttttttaaatgatcaatttcaaaatttagaaattaacttaaaaaagactggaatcgcattagagtcatatcatcccactattttttgattctcatacactgccatcatctaaaattagaagaaatatcttaactttagaaatacctatgaaaatgtgttataataatttttaaagcccttatgctaatgcccaagattttctttcacataataacaccacattaaacttacattgataaggaactgcagagtggtgctcccagcctgttgaatgctcactgggcgttctgttctctaattgggagttgacaatgtattcattccctagagctgttgtgagaaactaccacaaaccaggtggctttaaggacagaaatttattcttacagttctggaggctcgttggcagggttgaatccgactgaaaactttgagggacaatctgtctgggcccctctcccagcccctggggtctgccgctgacctgtggtacgacttggcttacagggcatcactggaacctctgcctcactcatcgcatggtgttctccttgtgtttttctttgtccaaatgttcctcttcttataaggacaccggccactggattaaggcccactgtattccagcaatgagctcatcttaactaatgacatctagaaagactcttttttcaaataaggtcatattctgggaatctgcatggacatgagttttggggtgatactctacaacccagtacaaacagcatggcataagagatttggagaaacaattcatagtcacaaattagggtcattgctttgccacaaattagttgccaattctcaagcaaaataatggtaacaatttattaaatgtgtgatgtgctagctacagtgctaaatgctttctatacacttacctcgtttaatgtgagaggtactattataataagattttggatgaggacttagggtaaataacttgccaaaggccacagagtattaagtggcagccccaggattggcactttataacttggatctggagcctgttatctgaactactctcctgctatttaaattgccaaattaagtgccccttcttacctgatttttacagtttctttgttttccaccccgtaatttagaaaaatacatatctgaagcagagaaatttgtgcatgtctaagttcagagctgttggcattcagtaaatattaatcaaaaaagccattgattcccttgtcatagaatgtattcatgtctaaagcctctgggcccattcacagccctagaatcgattttaaaaggaccatgatttgcctaatgaaactctaaagtcaagaaaggtgcagccagggtatgatataagaatcttgggttggttttgtgaaattaaacatcttctgtataagaacacagtttgttcttgacacagcagcaatgtcctgctttcaaaattcagtctgaagacccatcacttctattaagccctaccggggcttcccacacctcctggattaagagccaaagtcatctagaaaattctgccatgtccaggtacttatttcctagtgcccccaccccattcttttacgggtggcatgggtttctcagcatggtctctgaacaaagcagacacattccctatggcctgtggacttactggccccactacctggaatactttcctccagatgcccacctagataatggctgtgcctcctacatacctttgttcaagtgtgagctcctcgctggaccctatgtagccatatatgtatatgtgaaactgccatttgcttcctcctttctcactagaaagcaaactgcacttgggcaggcagcttggctgcttggtacacgtctgtatctgcagcacctaggacagtgccacatacacaagcactcaatatctagctgttaaacaaattaacggatgtgttaatagaatgccctgcacccatgcccttggaagtcgctcaggtgtccttctagagaccccttgtagaatgggcacatgaggcttggcagcccttgagctggttgggtgagcctaccacgtgttgcacctctgtggcaaaaacatcccacaagaatttctcttccacacttcaatttgccctgacactgggaagaagaatatgaatgcatccgctctgggaagacagaaagggaaggatcagaacaaagattttactactttttcagcagtagacaacgtttttttaagtaacatcttcagcctaatctcaaacaaaaggagataaaagtggtatagtattccccttctctgcagttttacttcttgataccgcagtcaactgaagttcaaaaatatgaaatggaacattccagaaacaaacaattcctaagttttaaattgtggacaattctgagtagcatggtgaaatctcaagccaccctgctccatcctgcctgcggaaataaaggatccctttgtctggagtattcacatgtctatgttccctgcctattagtcacttaggagccctctcagttatcagatcaaaaaaacatagcacacacagtgttcagtactatcagaaggttcaggcattccctgggggtcttggaacctatcccccgtagataagagagggactaccatattatgtcaaagtcatgctttaagtgcaaaattatactaagtcattagaaaaatgtgagaccaagtgactgctgagtcataacaccctcggtatccaagcatttctgtattttgttttggttgcctgcttttgaaaaaaacacaaatttataaaaattaatagttataaataagaccactttgaatctcagtaaattggcagtacaaattgaaatgacagcggacaccttattccgtactctataataaaccagggaggccaagtaatgtcacagtaaaagttaatttactgagtgaaggattctaaagtcttaaaattctgtacatggtatacatttttggtataagtgtttcttaaataatgggattaaagcaatataatatctcaaatctcagaagcacctctagaatctgagggttctgagtaacacagttggcaagtcactattttaaggaaccaaatttatctgataagaaattttggggctggacctggggtcagacagagaaaaacaaagtgatggaagatgagttccaatgaccctactcctgaacacgaatgaaccctgctgggatgatcttttgaaagaagaacattagagagagagaagaaaaacagtatcaaggacattataatatctggtataaaatttaaaaccatgattgtcagaccttgaagcatcaaacgactggtgcacttcaaaaatatttctaaggtaaggctcataagagccttacttcttggttgcagggttttacagaaattattttcatgaatgcaagtaggattggtttaaaaaatggtgcatcgtcaaatttgcaagactaaatgtagcgaaaaaaatcaaatcactggagggatggctatttttatacatgaatttcctaaaagtattagtataaggaacccaattcaaagtcaatcaagcagggataaaagtattgacatcggagtggattgaattcccaaggactggcttgcctagtttaatatttcccaaatgcatttggtggaaaattgattgcatctaatgttatattttctctcttttacaacatacaattatatcttacatcacatggatgatgccatccaagtaccacaatatctgtatactgttcaacagaaatgtttgctagcaattagatatatcacaagcaaattagaattagatgttttatctgatgtaacatttattctgcatatgtagagatattccaaaaggaataagttgattatagaaagttatgaaaaatgtcacaccaaccgagcttagtaagactatctgaagattgtatgggacaccaatatgaattcacaagataaaattttaaacaatatgagaagcagcatgttagcatgggattctctgtaaaaccttgaccaacactaggaaaacacaacttgatataatgaagcctgccttgaaaatacttttacaaggctaagtttgtggtgtggctttgaccaaatctttctttcacacgccagttaactactgacaataatattctagcactattggtaaaagtgaagattaaccatcctgtccctaaaacaaaaagaaatttcacagttatatgccaaggtttcatctgggaatatagttaaagggttcaaaagggactgcatgtagcaagtaagaagaagtaccaatctttttattttgaggcaacatgaaacagatgtagaaaacgacgccagcaaccacagcatgaatgcaaatgaaggtgcagaaaccacgcaactctttgttgtttggcttagaattttattttactgatgtgaatgaaatatttttatattttcaagaggaatatcccatttgtgattttgtgtgttagatttctcttgcttaaaatgtaaagccacctatattggcatcattggtttgagtcctattattgtgtattctggccaaatcttaatgaagacattctgtatgaactgtcagcctaatagccaatattgatgtaaatatatggatgtttgctttcagtttctccataaatcttttctatttttctagtcttctgaaactggcttcatgaaaacaaacaacacttcatacctgattactttctctagagttctgggttaatatctatgcactagactcactggagcacttacaaaacccagattatgaatgtttcctggggaattgttttatactcatggaacaactcagaatttattcattattcaagttaaaaatgcttgcttcctgagatatatcctatcaaagtcaacaaagattgactttacttccagcttgagaacatattgatctattttccagatctcaagatatatgcaaaaccctccttatgaaccttattcagcattatttccataagcttttgttttcagctacaaaaaaatgaacacgaaaatttgttttctagtgtaagtttggtagtcattgtttactctcattttaaataaaatgtgtaacaggataatatactctgttcaagaaacacattatttactatattatcacaatggtaaatgagcacttagtgaacatgactgatacattcatgtcctagttaatattgaacactctcataacttaatgaatatctgcttaaacgtattaaatcaaataaataatttagcattaaacagcaattgtgtggttttgccatttatttctccaaacatttttctctcttctataatttgttcatttacatgccagagatgtcctaaaatattgtcattactattattaagatgtttgataagagctccatctaagaaaaaagtccaaaagcatttcaagtgtgagaataagagttggtgaatttttaatgtctgtaacatctgggatatgttgatggaaaattgatgccttttgttataattttacaacaaaatgaagagaacatgaggcactccttcccttccatctatttaaatcattccttttgttatgtgattagccagggttggcaactaattgccaaatgttacaacttcactcaatttcctactaaaggaatttgattttgaaataaattaattgcctacaccaattagggccttgaaacacaactttgtgtatatctgagggtggagcattggagtaggatgaacactggtcccttaaaagatatccatcatcatctctgcaacctgtgaagttaactcatacggcaaaaaaaaaaaagaaaaaagaaaaggactgaagataattaaattaaggatcttgagatggagacattaatctattattcagggagcatctcaacatcactgaaaacattctcatatgaagcaggcagaggaagatgcggagcatacagaggagaaggaaatatgaccgtggaggcagagatagtgatgaaggagcctcaagtcaaggaggccggcagccacccgaagccaaaagagaaaaagaacaaattatttcccccaaacttctggagaaagtgtggcccgggggacccctttattttagtcgcataagaattaatttggactcctagcctccagaactgtgagagaaaaaatttctgttgctctaacccaccaagttcatgataatttgtcacagcagccatacaaaactaatacatacatacatacacatgaattacacacatgaacacagtcacactcaagcgagtttaggagcatggggtggacatgttagtatctgtgtgtccatctaccaaacatctgggccaggcccattgtacgaaattggaacatgtcatcccaaaatatgcctttgtcatgggattattttgagctgattattttgagaaagcctagacacaggagaagctctgaaaacagagtagaaattgtgtttgtgtaaggtaagcttacatctataaaggaaatctctatttgtaagggtgtctcccctactgtaccaggaagagaaatatgatcctggtcaggagataagtcaatggagaagccactgacttaaatgtgcacaacaaaccttactccggctaaccatgccatttctggtcacgttgccattacttacctctcccacacacttctttctttaatctagctgaagatggtatttaagcttgaattctaagatatctctttgagagtgactcatttccctgggtatctcccgtgtgtgtaagacataaacatatttttataacttgtttttctattgttaatatgtcttttgttacaagggcccagctgagaatttagaagagtagagggaaaattatttcttcctgccctacaatatatatgaaagatgtagttgttgatataaaagacctcttaaggaaaacatgctgtgatcttgggcgtcttgaaggggaacactcaacccagatgtagggatctggagatggatgaaggaacatttcttagggaggtcaaggcttgagctggatcttgaagcaattgaccagtgagtgaataagtggaagagtagatgttcaagaaaagcaaatgaataagctggtgcaaaggcctgaaatgggaagaaaggacatctaagctggagaactggaccccagggtggggattggagaggtctctggctacacgctgatatgcagctcaggacaggcctcctgaaccatgctaaaagaagttagttcagatttatttttcatgagttgaagaaaagccatgaataaaattttaagcaagatattggcatggtgagagacaagtagttgagaaagacttctctgtgggtataagacctggaaagcagtgtggctgtagtggtgaatacaaggagagtgatgtagaggtcattgcaggcaaccagcaggtaggcattgggaacctgaaattagcagggacaatagggatagaagaagggatgggtaaccagcaatttagtagtgggaagggcactgtcttttgatcatgtagatgtgtgggtggacagcagtagcacaagtctgcctaatctacagtatgaaactaattcccacccattccttaagctgggtttggactgaatgccacacacaattctgaactgctttctttccacccccataagtaactttaaccttagacaaataaaactacctatacgatcctgtttaaagaaaacacaataagacagtaaatcttccaaaatagcaaagtagttcaagaaaaaagaccgaattcatacaatgttttgatcatcacacttttaaatcaaacacactttagttcattggtaatacattctggatttttaaaacaaatggaaaaccaaccaaagaaaatcttatgaatcacatgaaagttacctttaaaactgtaggaattcaaagtaattcagtacaagaacttctttttcaaagtaatacaataatgatttatttgtttggaattctgtgtcctaagtcaagcaaataagatataaaaaattacacaaacataaatttcaaaatgagagaaaacttacaactcttgacttccaagacatttagcaaagctaaagaagttggaatttaaaagtggaaaaacataagaaaaatagactaacaaattaagattttcatatctattagtattacatttttcttagattttcacatgctatggttttaatgctccaccaaaatttatgttgaaatttaattgctgttgtaagtattaagaggtaagacctttaggggacaactaggtcttgagagctctgtcctactaaatgggactaatgccattgtctcaggagtgggttagttataactggagtgggtttctgagaaaaggataaatttgggctagtgttctccctctgtctcatgagctttcttcatatgatgccttccatactaggatgactctagtcagaagctggcaccaaactcttggacctcacagcctccagaaccatgagtcaaataacctaatattttatataaattacccagcctatggtaatctaacagcagaaaaagtgctagacatcacatctgagaaaaattctgaaaagagccatgctattaaatgctgatattaattgtctccaacctagaagagggagggcatttcttccttaatcagccaactttagaattcacactaaagtttcagctgtactgtgtctcaattataattcacaatatcaacagcaaaaattcaatgctattttctaaaaatactttaggtatgactctgatttctcaagttttgactatgactatgagtcatgactaccaacatttagatcagcactatgagattaaccagaaccaatatgtaaatgtatacggcagaaagccatcaatcaatctggagtggacacaatgtttccaagtgtaactataatagaggagcaaagcaaaaacagaatcctggaatcagacaatgtgtgacagtacaacagcctaaaagagctgccggcaagacatattgggaaagttagtccaaaggagcacatccatgctcaagagataagaatgaatcaactcctgatggggaagatggctggtactcttctgcccatcataactaactctaccctcccaacaatctagggtataggtaccagtattacattcatcttacacagtaggtagaaaggagcttaacaacttgccaaagattactgagcttttaaatggatggcctgggattatgaagtcaggccaccctggctggctccagggtccacaatcttaacccacgtgcgatggactctttcagtgaatgagttggcaggatctcccagattcctaattccttcctgtctcaccagagttctattgacagattgagtttgtttgctttgaacttgtcagacaaaataaaatgtggtgcttttgaaaggcccttggtgggaaagcggggaatgaaatggtttggctggagagagaacactactccacatcttcactactgagatttcaacccagttgttatgatttcagtgctgatttcacaaagtcatcgattcgaaagcttcccccattcccaccctgtaatctgaactctgaaagtacatggaaaacacaaaagtaaacttaattgtgaatagtcttattattctgcaattttgtgtaattatccaaacccacttgaaataataacagaggtcaagacaaagaacatgcacggataaacatggatattgttccataacctgacacattatatgtgggttaagatctttacactatacaaagaaaattcaaactgggttatatttcctaagcgagtttatacgttgaattaggagaatacagcaaaaactatcccatggagacattatgcaaactggtaagcatggaggtcatcaagccttatgtactggagatggtaggacagatccatccattattcaagcacagccaagaaagtgcacttgaagttccaatctaagattctaagattccatattcttcctttatggtaaaagatgggttccaagtttcccatatggaatataatggccaagccctttcttatacagctcagagcagggacaccctggggaggtgtgaagaaccgtggaagagatgaagatgagggcctagtgcactcttgggctctcacccttttgcatgggctagctccctgctttctgacctgctccctaccagaacacagctcttcctcatccccagcctcactatccccctactctcctctaattggagtatccacctcattagagtctccttaaatggtctcagggctgacaataacacaacaatttatggaagagctaaacattcctccctatgctatcacacaggcaatgggtaagtactgcattttaaatttagtgctttctaggacaatcataccccaaaagagctctaatatgtctgaaacaagtaatgctaacagagttgtctgcctcatttcctaatgcttcaagctcttattaggctgaataattaagaaaactattttttcttctttgtttttccaagtatgataactttcttccatacatgtctatataagcttttactcaaggacagctgatttaatgggttgtgatgacggataattaagtctcttaattattctcttaggattattgtagctgtgaaaatcaagccacatacacatacattcaaacagcaattaaaaatattgaattgctttttaatttagaaattatttctggttttggaagctatctctggccccaatatgctcatcattatatttgcatattcaaagactttatcagtcttcataaccattttgattggtctacctcctatggtgttttgacaaatattattataatctgttagatttatgttcctactaatacactatccaggtgatttaacaaacatatagtgtttcgttatccaattttaatagaacctataaaaatacaaatgtaactagtccaaatgtggtacaaaatctcatcctttcaagaaacctgaatctggttattaccaaaataattccttcctgtgccatctacaccagcctctactttccctttaaataatgatgagcctcaagagaaagaaactcaacattaggaaggagcttctatattgcctttacatgaataacaaacaaaactattatagcatgatcatcctaagataaaacagttaactttgctcctccatgcctaacatcattaaggacattccttgaggttcagtaatgtttaatatcaatagattcacaacatacaaaatagaaatagaaacattatcaactatataaaatcacttgattggttctctaccaagaaaatgccacaaaacaggaagtgttaactctccagtaatattcctacatagtcagtggaacttgtaaatgtattcaactaatatttactgagcacctattatgtaacagaatttgggatataatatgagcttttctaaagcctgctgtattttagaaattcccagcctagtaaaggcaagagaaaaaaagtaattgtaatacaagttgagaagtaaaggtatatactgtaagaacacagagagaaaaacacgtttgtagagaagatggaggattacacagcgatgcccagcccagcagccacctgagcaggaatgaagggaagatagaagttcttgagagataagagagacgtatgcttgctgaaaacaggtaccaggatgtgcaaagtctgtgagaagtggaaaaacatctcacattcatgaaactgcaagaaatgtgtatggctgaatgccacaaggaatgttgaggaataagcagatcttgaagctggaaaaacaggaaaggtcagaccatggtgtttcatacaggatattgtttgaaaataggattttttttttaaatttaagagttttaagcagtaaggtaatgccatagtttacatatattaagccatgaaccacagtaggaggcaggaggaatggaggacacagagcattataaacaactgcccaaggccagaaagcaagtaaaggagctaagattcaaatgtgatcagatgcgcagtttagaaggatgacttgaggaaaaagggatagaatgtatgtgaggatagaatacaattaataaaagattagctagtttaagcccgtggtgataaggcaacgaggctgaattcaataagcttgaataaggctgaatgcactgtaagctgtagactagacagaacagtataagtacacatttagggaccatcaatgagaacggggaaccagcaaaggcatccattgctctggacaaaaggttatgaatctgatctctgaggtcagtttaaagagctccatccaaatgatgatagtatgaaaaactattctactgttcaggaaagaagttagtttggaggtaaagacaaaacattccttatcttgatttttgtatgtctttgcttgggaacaaaggagatacagtgatgtaagtgtggctcagatgttttgtttattttgactttgcttcttttgaggggaaaggaatggaacaagaagtcacctacaattgctcacacaatcatccatctgcatttgtcatagctggtcaacatgcagggtccacaccaaggtgctgaccacattatgggtatgattaaggatgaggaccctcatgtgaaatagctttgttgagcgtgagaaacaatgtgccctaacacaaagacatacggcttgatcaccatgaagtggggatcacaacaattcactacagctctttttcctaaagaacagaacaaagtatccattatagcatttgacaatctaagcattccttctgggaccaccttctgcccatggctcatcctgtccaggttttcttcctcatcactagctgctccttctcagtctcctttagcagactaagctgtgtttcctccaatggtggcatggccctggcatctgcttcggatccttcactttccactcttccttcctccttgggtaatattaccttgttttatgacagcaaacaccatcagtacaacacacctgcattcctgtccattactggaaagtattaattcttccacctctctcctgggtatattccttggcatatccaaaagcatctcaaacgtaatacatgtaaatcaccagccatgatttccctctctgcctcccaacttgcttctcccctagtgttgcccatacactacccacttagttgctctggtcaaaggtatacaagtcatccttgagtcttcttgtttcctcactgccaacatccaatccaccaacaaatcatgttgactggaactaacaaacaaaactttccaaatgcgtccatttctctaccagtaactcttgcctaaattctaatgcaatttcctaatggatgtccttcctataactttgtcccattataaccctttcctctatgactcacccaaaagtatctttttaataagaaaaatagatgatgtttaataccttcgagtggcttgccatttaggtacctaaaacacaattcaaagtcttgggcctggttcacaaagcttgaggtgtttctgcctccaattctctgaccccgtgtgtcaccattcctctactccttgagccctgtgatccagcaactctaaacctctgtaggttcctttagccttatccactgttccctcttccaaacctttgtattcactgagctctctttcccaaaggtgctttccctcacctgtgcctgactcctcaatattcagatattgactcaactgccactctataagagtagaccattctttgccaccctatctacaagaacttcataaatactttctatcacatcactgcatttgaattcttggcagcacacttaccagtttctaacacttttcctaactattaattgattaaatatctcctccaactataataacactgtaagagaagtccttcccttggttcaacactttatttcctgtacttggaagtctgactgccccataagagaccctgattaaatatgtgctgaaggaaggaataatctaggagtttgaaatgagtttacttttgcaaacttctgtctgaaggtaggaatttcaaggcgagagcctcatcacatttgtcatcaggtgaacctggttttaagagtataagttcaagattagcatgaagagtgaaaaaatcagtttgcatttagttttcaaattcatcttgcatatctatgtgatgtgaataataatctctgaccttcttggttcataaaattgttgtgagatttaatgagatagttacagaggcactgtataaactctcaggcaaagtaatttagtagaaatagttgggtctgtagtcttctgtctgcatcaccaactggagagcttattcatggcatggaggaatttgctggtacattgagtgagtgtggcttaactggggcggtgggagttgccacctggcccttgaagagttttgcatctggcaataatccagagaatgactccactgagaggtaataaacacagagaaaactctttacctatcatctctatgaccttctcacagcgtcttgtattggagacatttcaattgttccttggatggaaagtagctcaccttttactgtcagcaggacacatggtacatgtgccattacgttgggaaatggctgcacaactattctaagtggaaaagtaaagctctacacatctgtatactacccacatagatcttttttttttccattctacattaaatgtcactgaaagtagatcaaatgaagtgcaagctcccatgtcatcctggaaaatgtccatgaaaacagtcagcattaacacaaaatgtgtggtttatactagggactgagattctattttgctctaaaaaaaaaagactataatttctcctgacagatgaggtcagtgaataatgtttaaaatagatgacgtccccttacttcttacccttccccttggtcataaggcaccactagtggttcagaacccccagcattacaaccaccattacatgcatcaaggtggtggtcagggcttgcagatgttttattacaactctaccaaggggcatccatgggagggttcagcaaagcccaggaacagggtacacaggggtgtgcagggcaagtcagcccctagacagctctgtacccagtaactgaggcctcagaaggcagagagaagccaagtaaagggcaaggagggtgttagggtgttttgtttccttccttcgaggctatagatgataccactacaccctacaactagctgccagcacctagtgcaaacatgctgagattttgacctgctgaatacacatttggactgaatactgaaaagtcgctgagaagaaacacaagggggaagaactgtcaaatggcatggcatattactaacataaaaaaagaagcattcctgttgatttgaaaagaatatcaagagaagctagaagccttaccatcgccccttcaaataggttatcaaatgctagcttcagtcctaactctatattttcatgtaagttcttaaattaagaggctcagggaaccaaaattttactatgcaatgaacatcttggccattgggttacaaatgaattgatcaaacttactttgtcttgggattggatttaggttacctattgaagactggtagccaaccaggcgtgctgtctttcagtgaggtggcaagagaccacaggcctatctcattctgtcttctccactcgcaggctcaaatgccaaggcctcaatgcactggctctctctctctccttaagtgtacaagacaatggaagaagtcttgccctaatcacccttaggttatccaggggaacaaagagctgggctgaatcctggtgatgagatttactcaagtctttttatttccctatccctcatttttcctcattgcttgctggatataataaaaatagcaacctcaaagggtcttggtgagtattaaggagtgcttacaaatagcatttaatccagtgtctgcacatagtaagcctgtgatattgttaactacataattacttccactattatttgtcttttcttctttctttctttttttttttttttttttttttttccctgagatggagttttgctctatagcccaggctggagtgcaatgtcatgatctctgctcactggaacctctgcctcctgggttcaagcgttcaagcaattctcgtgcctcagcctcccaagtacctgcaaccacaggggcctgccaccatacctggctaattttgtatttttggtagaggtggggtttcaccatgttggcgaggttagtctggaactcctgacctcgggtgatctgcctgccttggcctcccaaagtgctgggattacaggcatgagccaccaggcccggccccattattttttacaaaaagcctttttaatcccattctaattcttttgctatctgcctttcacttggaaatacagctacaatggaagagagaaatgcaaactgcttctgggcaaaatttgcttttaatattctcaaaaggtttgtagtaccaaatttttccccacatgttcacttgaaattattcttcactttgggggagatttaaaaataaaattttagtttccatgtagttgagtggctttgagtgagattcttaatcctgagttctagtttgattgcactgtggtctgagagatagtttgttataatttctgttcttttacatttgctgaggagagctttacttccaactatgtggtcaatcttggaataggtgtggtgtggtgctgaaaaaaatgtatattctgttgatttggggtggagagttctgtagatgtctattaggtctgcttggtgcagagctgagttcaattcctgggtatccttgttgactttctgtctccctgctcctgaatgactactgggtacataacgaaatgaaggcagaaataaagatgttctttgaaaccaatgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaagaaatggatacattcctcgacatatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcgtcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattggtgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggcattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggaactcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctgcaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacatttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaactcttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaactggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagattataataaaaaaaaaaaattaaaaaaaaaaagaaaatatatttcttataaaataaaatattttcgaaaaaataaaaataaaaataaaattttaaataaatgcctaaggaattccaaatgatttggcaagctaaatccattctgtcaatagaaaaaaaaaaaaagatacagatgtctctgccaacaaaaaatcggttcagaatattaggttgtttattgcaatatttgtatttgaagaaacccacaatggttctgtgcattaagaatttttgagaatttgttatcattgaaagaaagaaaaattcccattccccattcttttttactccgtcctccaggtcatctaagtcaggggtccccaacacccaagccacggactggtcctggtccatggcctgttaggaaccaggccgcacagcatgaggtgagcagcagacaagtgagcgttactgcctgagttcctctgcctgtcagatcagcagtggcattagattctcttaggagcatgagccctattgtgaactgcgcactgcagtgagggatctaggttatctactctttatgggactctagtgcctgataatctgaggtggaacagtttcatcccaaaatcaacacccaccctttccccactgccccaatgctcgtggaaaaattgtcttccacgaaactggtctctggtgtcaagaagactggggaccactgatctaagtcgttagaactcttgtattctaccattcaacctttacctatgacatgaatttaggttcttgcaaaagaaagagaacataggttttcatgcctgtgattaaatgcctatgatctgtactttgccatgtgattccatggtgggaggcaagttatcctcatcgatcacatttagagtttaaccacatgagctactctaaagaagatgttctcatggctgagttttccctgtgtctcttgggtatttctcaatgtgcactgcatttagaaataaatctcaaagtgctctgatgacgtatcttttctcaaacacacattcccctcatctctccccatctcccctgcagaaattgataagaagtgaatttctctagaaaatctagttttgttgttgccattaaactaattttaggattggaaactcacatatatggtcactatgtgcctaccttctttttaggaaacatgagtctgtgatgaaagatataagtgaatccaaattcaagtttaattttggaaaccatatggtaagataagaagagaataaaacatagccttcaaatagatcacattagttttcatttagacctattatttactatttaagaacattttacatttgccaaatacatttctataagccaagaagaaccaaatttttagagctagaataaagacagaaaaaagcaggagcccagaaggaggaaaagaaaggaaaaagaaggccaggaaggtgagggaaagtgggaatagtcaaaggaaagaggatggcaaggacaaagaggaagtgaaaaaaacattaaaccatctaggctccaagtaaataacgcattttatttcaatatgtcaaagcaaatcctagaataacgtaccaggcacttgaaattaaaatacagccatatgctccgggaatgattttacaaagaaatgaaggcagaactgatgtcagctgaaccacttgagaagaaaatgccctacagttctcagcttcggggttccaggttgctgggggtgtggcattctcatagtgacacctcccaccctgaggtcatagtgacacctcccaccctgaggtcaccagcgggttaatgttcagtttgcccttggtagatcctggcaaccaggaatggcaacataaaaaaggaagcacatctctgttttataattttatgtatcatatttgaggacaaaaatatatctttccaagtaaaatgaatctagttcttaagtaacaacaacattcatcactctcaaaagtgtgaggggctggctgacttcggggtgggaagaaacatggggcgagggtgcagtggggaagaatcaagtttctttacctactaagtacattatcccttgtttcaaaccccaaagacgtgaacagagattgactttgatctgaaattccttctaatcttactttgggagccttcattataatgcacatgcatttaggaataaaagttagggaaaattcttactatgtggattgaatgactgaaactgtgagtgaatggtctgttgtggatgaaataaggacattccccatagccccaaaccaccgcgagacattttggtgtgagagtaaaattcagctccacggtcgtgtgctagctcagcatctgggaggaaccaggagggtctccaacggcctaattacatattcccctcctgaggctcctcttgtggatgaggtgctctagacaaataacctccttattagaaggacaggcccagttcctgcctatccatgaggtgtgggcttcagctccctaccagaccatataatttatctaacaagtcaatcccatccttctatggaaaccacaggcatcctaccttccttccactgtaaggcctgcctcccacagccctgtgatgttcaactcttctgccgcgggactcccatgtggctttgtgtggtgtgtgcggtcctcctgctccaggctgtgagtatatgtgactcataaactgctgctgatctcatctgtccagtgcctggcgtcccatgttcagctatccccataactctagggcaagggatccctccctcacgaataagacaaacaaaaggaaattaaaacaagcaacttctgaggtctgctaaaccaagttcaagtgagctgtccacttagcgtctgtttaggccactgcaaggctgctttctccctaccctgcaagtctgggttccagacacaggattcagcaagccctggctggctctccagcaggcgctcttgagaatgttaagggctcagcaggcacaccgtgttttcatgttcagggcctggcatctgaaaaatgctaggcggagaagggcagtgttttgcggaggaagaccaaagagtaattgctacatttcaacattccttgccccacggctgccctgcttccaaatctctcccacattttctcccacttaccgcgaaaaaatccatttatctcacatttcccaatctgtttgtgaacaaaaggcatccgtcctcaatgccgcactgtatgagctccaaatactgctggtgctacgtctgccttgagggcattttaggagagcagggaatggttcgagtctctgaatacaggttgatgtttccaaaggagagaacagtctatccatggttctgtgttttagtttgatatatcagataacacaagatgccagagttatccagggcacattttaaagcacaagtgagcttctgtgctaagtatcttataaatagagtcttctggcaaacttctgcttttaaatactattattaatgagaatgaatggaaataaatgatctggagggtttcctgttattcgtgacaatctttagagggccatggctccttaaatgacgagatactacacattttaaaagtctctatcaatctaatgataaaatgctaagttgaatacaccattattatttaatgtaatttcaggctaaattagaaacttttatctggtcccgtaagatagtgttagaaaacaatattttatcttctaagcaacttcttctcaccctcatgagaaagaatgtaggaagattatagcaatgaaataattataactattctcttttgatgggacaaagtaagcatgattaacttatttatcctacagtaataaaggtaacttgtccagctcagaaagcccatgaaactctagccaacttgtggccagaccctgtgtaactcactactgaaccccaagttcagactgctgaataaatcaatacaaactcaactttaccaaagcagtatcaatatggaaagttcagcaagctctggatattggaagagtaaatatgaacacctaatacaaaatacctaactaggtacaaaatgaaggagagagattttaagtatgcacctaatttaattctcagaagactcccttaaaatcccattgtacagattagaagcctgagattcagtgaagacgtgatataccttacagagctctgcccagctagaaagtagcagaatcaaggtggatttctaggttgctggctcaaaaccttcgaacagctctctgagtccacattgcaaacagcaggatgaggctcttacctgatgttcacattcagaaaagattagattcttatttaatatatgagccaggaagaatttcagctgagaagcccgccacactttgcaggcttctgggtttggaaaaactcacaacataaaatctcatctgaatctcctgtactttgcctctatatcgcgctatcaagctgttgcccgatccacttgaaaactctgctgagctgaaaccatcaattccttgtgacagttcattgaatctttggtccactttactttaggaagttcttccttaaactgagtgacatcaatcaccccataccttgtactctttagttctgggtctatgccttaatgacacagagataaattcttaactggtttccacattattgtgcttttcttatttacagaccctgaaatcttcctcctgggtcttctagaccagtgtttctgaaagagagtattccttctctcatttctcagataaaaggcatctgattcctctgactgccctggtctctttcttcactcttctttctgattagctagacctcaaaagtatagaattcaactaaaatagttaaagataaaaagacacatctgagatcgacttcagaatcatctctggccggggtgggcatgggcgaagtggataaggaaagagatgagaaaagatttacagaacacgtggataactttttaaattggcagctgggtacaaagggttttattatactattctctttacctttgtctatgattgaaatttttcatgataaaaagcttttttcaaaagtgtagcatgcaaaaacatgcatatgacaggatctgttagaggaagctaagttatcacatcctgtatcataataatataaattgagtaataaaaatatgattaaaaatttgagccatgtaaatatgctaatttgtgccttctgaaacacctatagtattggttatacctatagtagttggttcttgttgttcttgtaggtagtgcatttagcacaattgtagggcttcttatttgcccttgaaaattttttattggtagatttcatctgttaagaatctatggaccctaaagctgtcaatcagctgattcacttgggatgatcctcaaatatttttaacacatcgataaaaatacagagacaggctgagtttagaaacctagagaatcaacttccaagacattttctgtgtgtggaagatgtgcacagctagcagttcagtctggaaggatgactgaacaaacagtgataagaccacccattcactgaggaaaacacagaaaacggcgtcatgagactcccagggaaggaaatgtaaagcttactttttatccttttttggcaacacagttcagaatttttcagtaaatagtaatgtgatagcactgatctggaatttgaataaagctaaattatgatggaactaaaaatgccatcttaataaatactactgcccccaggccataagagttgatacagaggtaggaaatattgaatccataagtgagcaaaagataattagatgttaataaagaatttattttccccgcactgtggcaaatttcatttacatcacacttcataaataatcaccttcaacacttcaacagattgctgtaatttatcataaatttttaaaatgctaccttgtatatatataattaatcagcaccaactgcttgaatttgtaattgcttaataatttggggataaattattatctgtgttttaaacatactaatttatttttaaagtaagtatatttctatttgttttagaaatgatgacaatttccagatcaagagctaggaaggcatacaacatttacatcgtacaattaccttctggatgctaaggacaaaacacatttttgtttctccaggttgcaagatctataggctgatagaaatgcatccctctgcaacaacacacagcacatgtggtgggggaatgaactgagagaaaatccgcgggatggagactgggagcctcatgcctctaatttgtcatcacgctgaatcatccaacatcctcacctacaacaaattactgagactagcaccctgcttactcccttccccagctctgtgagagacaccttggcgccagatggcaggcaggagatggccaggcagataatacaggatctcctgtaggcatggaagcagtagaaatagatattaataataatcacctattgtgttggagctgtgacttgtatctgactcagtagaaagacaatggagatggctatggaattcctaaaaagtacaagaacagtatttgtgttctggcttggttttgattagctatgcaaccttgagcaaatggcctcacctgtctaagttagcgtactcacttgaaaatatggggagaaaataataaatgccctaattaccaaaaaatggtgaggtagagcttgaaggagataatgttcatgaaaatattcttgttaacactaaaatagaatagaaacattgtaattacaactgctgttgtaagagtagcaaaagagacataaaatataaaatgtaagattatacatggtggtgaccttaaggcttctataaatttttataaaatatctatttatattctctatgtctatatacatagtatgaaatgtaataaatctgcatatgcaaaacataagaattagttctaacactcacttctgagttaggaagccagtgttattaaattccgtatgacaatgaactccatccagtcccctttttacagctgcacagagaagacttagtagagtaggcctgagactgtcatcctagaagggcctgcttgcaaaattggccccttagctggtttctgggagctcagatatcaggagggtttccacaattccctgttaaaaacggctcactgtgcctcaattattaatacatgcaaggtggtttacgcaagcatctgctttccttccaggagtctgcaattttaatacattccaggcagagaggtcctgtgtgatctgcccgcaggagaaacccagggcattgagcctctctggtagacaacactctcctcgtgttgtcacaatttgctgatggaaggattaagtgcatccagtgtgattccactggaagaagactcttggaagatcacaccttgttttcttcatgatctatccatgcacctcttgtctttgctaatttttttttccttcactgtaataaatcacagccatgcatgactacatattgagtccttgagtcccggagaattattgaacctggggtgatctacgagaacctcaattcaatagcattacaaatctatatggaaatgacaattttcagagatagatgacccaaaacttgagcaagtcccataggaaacaataacaactctttctagattctggccagaaaaggaagtatgaaaggtactgagagcgggggaaagtcgagtctggttggaaacacagcattcactttgggagcacattctcaggttgcctgagaactgactagagatgcttccaatatacctagaaagcagcagcccagatttggcatactctgatgttggggcagcgggtgggggcagggggaggagggtttccccaggacaaggttaaggagctttgctttacctggaacttctggtcaaaaaagaaaaaaaaatagattaaatataagccataatgttattgagatctaagaggcagacttctccaatgtacatcagagtagcaaactacagcctgtgggtcaaatccagcccattgcctattttctgatcacttgcttgctaaaaataggttttatattttcacatattgaagaaagaatttgtgaatgtttgctttctcctttttaacataaggaacttgatacggttttgttctctgtccccacccaaatctcacgttaaattgtaacctccacatatcggggaggggcctggtgggaggtctttggatcatagtgacagatttcccccatgctgttctcctgatagtgactgaattctcatgagatctgatggtttaaaagcatgtggcactcccccgtttacttgctctctcttctgctcctccatggtaaaacgtgcttgcttaccctttgccttccaccataattgtaagtttcctgaggcctccaggccatgcttcctgttaagcctgtgaaactgtgagtccattaaatctcttttcttcataaattacccattctcaggtagttctttatagcactatgagaatgaactaataaagaaaattggtaacaggagtgaggtacggctataaacataactgaaaatgtgaaagcgactttggaactgagtaacagttaggggctagaacagtttggagggcacagaagaagataggaaaatgtggaaaaatttagaacttgctagagacttactgaatggtttttgaccaaaaggctgatagtaataaaaacaaagaaggggactgctggcaagatggcagaataggaactgcagctcccagcaagatcaatgcagaaggtgggtgatttctgctttcccaactgaggtacctagtgcatctcattgggacttgttggacagtgggtgcaacccaaggagggcaagccaaagcagggtggggcatcacttcacccgggaagcacaatgggtcagggaactccctctagccaagggaagccattagggattgtaccatgcactccggcccagatactgcacttttctcacgctcttcacaacccacagaccaggagattccctccagtgcccacactaccaggaccctggggttccagcacaaaactgggcggctgtttgagcagataccaagctagccacaggagttgttttttcataccccagtggcacctggagcaccagcgagacagaatcattcactcccctggaaagggggctgaagcctgggagccaagtggtctggcttggcaggtttcaaccccacagagctcagcaacctaagatctactggctggaaattttcactgctagcacagctgtctgagctagatgtgggacgctggagcttggtgggggtgtaggggagtgtctgccattgcttaggcttgagtaggtggttttaccctcacagtgtaaacaaagccactgggaagttcgaactgagtggagcccaccaccgcagctcagcaaggccactgaagccagaccatctctcctctctgggcagggcatctctgaaaaacatgcagcagccccagtcagggacttatagataaaacccccacctccctgggacagagcacctgggggaaggggaggtttttggcagagcttcagcaggctgaaacatccctgcctgatggctctgaagagaacagagatctcccagcacagcatttgagctctgataagggacagactgcctccttaagtgggtccctgatcccggtgtatcgtgaatgtgagacacctcccagtaggggccgacagacacctcatacaggagagctctggctggcatctggtgggtgcccctgtgggacaaagcttccagaggaaggaacaggcagcaatctttgctattctgcagccttcgctggtgatacccaggcaaacagggtctggagtggacctccagcaaactccaacacgcctgcagaagaggggcctgaatgttagaaggaacactaacaaacaaaggaatggtatcaacatcaaccaaaaggatgcccactcagagacaccagccaaaggtcactgacttcaaagaccaaaggtagataaatccacgaagatgggggaaaccagtgcaaaaatactaaaaattccaaaaaccagaatgcctcttctccaaaggttcacaactcctcaccagcaagggaacaaaactggacggagaatgagtttgatgaattgacagaagtaggcttcagaaggtgggtaataacaaactcctctaaggtaaaggagcatgttctaacccaatgcaaggaagctaagaaccttgaaaaaagttcttgaaagttagagaagaacataaatgatctgatggagctgaaaaacacagcaagagaaattcgtgaagcatacacaagtatcaatagctgaatcaattaagcagaagaaaggatatcagagattgaagatcaactcaatgaaataaaggtgaagacaagattagagaaaaaagaagtgaaaagaaatgaacaaagcccccaagaaatatgggactatgtgaaaagactaaatctatgtttgattgggctaccttaaagtgacaaggagaatgaaatcaagttggaaaacactctgcaggatattatctaggagaacttccccaacctagcaaggcaggccaacattcaaattcaggaaatacagagaacaccacaaagatactcctcgaaaagagcaaccccaagacacataaatgtcagattcaccaaggtcaaaatgaaggaaaaaatattaaaggcagccaagagagaaaggtcaggttacccacaaagggaatcccatcagactaacagcagatctcgcagcagaaactctacaagccagaaggagtgggggccaatattcaacattcataaagaaaagaattttcaacccagaatttcatatccagccaaactaagcttcataagtgaatgagaaataaaatcctttacagacaagcaaatgctgagagattttgtcaccaccaggcctgccctacaagagctcctgaaggaagcactaaacatggaaaggaacaaccagtaccagccactgcaaaaacataccaaattgtaaagaccattgatgctatgaagaaacggcctcaactaacgggcaaaataaccagctagcatcataatgacaggatcaaattcacacataacaatattaaccttaaatgtaaatgggttaaatgccccaattaaaagacaaagactggcaaattggataaagagtcaagacccatcggtgtgctgtattcaggagacccatctcatgtgcaaagacacacataggctcaaaataaagggatggaggaaaatttaccaagcaaatggacagcaaaaataaagcaggggttgcaatgctagtctctgataaaaacagactttaaaccaataaagatcaaaagagacaaggacattacataatagtaaagggatcaatgcaacaagaaaagctaattatcctaaatatatatacatgcaatacaggagcacccagattcataaagcaagttcttagagacctacaaagagacttagactcctacacgatagtgggatattttaacaccccacagtcaatattagatcaatgagacagaaaattaccaaggatatccaggacttgaactcagctctggaccaagtggacctaatagacatctacagaactctccacaccaaatcaacagaatatacattattttcagcaccatatcacacttattctaaaattgaccacgtaagtggatgtaaaacactcctcagcaaatgcaaaagaatggaaatcataaaaaactgtctctcagaccacagtgcaatcaaattagaactcaggattaagaaacgcactcaaaaccacacaactacatggaaagtgaacaacctgctcctgaatgaccactgggtaaataacgaaatgatggcagaaataaagatgttctttgaaaccaatgagaacaaagacacaatgtaccagaatctctgggacacatttaaagcagtgggtagagggaaatttatggcactaaatgcccaaaagagaaagcaggaaagatctaaaatcaacacacttacatcaaaattaatagaactagagaagcaagagcaaacacattcaaaagccagcagaaggcaagaaataactaagatcagagcagagctgaaggagacagacacatgaaaacccctcaaaaaaatcaatgaatccaggagctggtttattgaaaagatcaacaaaatagatagacttctagccagactaataaagaaaaaaagagagaagaatcaagtagatgcaataaaaaatgataaagggtatatcactaccgatcccacagaaatgcaaactaccatcagaaaatattataatcacctctactcaaataaactagaaaatctagaagaaatggaaaagttcctggacacatacaccctcccaagactaaaccaggaagaagtcgaatccttgagtagaccaataacaagttctaaaattgaggcagcaattaataacctaccaaccaaaaaaagtccgggaccagatggactcccagcctaattataccaaaggtacaaagagaagctggtaccattccttctaaaactattcaaaacaatagaaaaagagggaatcctccctaactcatttcatgaggccagcatcatcctaataccaaaacctgcagagacacaataaaaaaaaaggaaaatttcaggccaatatccctgatgatcatcgatgtgaaaatcctcaataaaatactggcaaaccaaatccagcagcacatcaaaaagcttgtccaccacaatcaagtcagcttcatcccagggatgcagtctggttcaacatacacaaatcagtcaaggtaatccatcacataaacaaaaccaatgagaaaaaacacatgattatctcaatagatacagaaaaggccttcaacaaaattcaacaatgttcatgctaaaaactttcaataaactaggtattgatggaacatatctcaaataataagagctatttatgacaaacccacagccaacatcatactgaatgggcgaaaaactggcacaagacagggatgccctctctcaccactccaactcaacataatattggaagttctggccagggcaatcaggcaagagaaagaaataaaggttattcaattaggaaaacaggaagtcaaattgtctctgtttgcagatgatatgattgcatatttagaaaatcccatcatctcagcccaaaatctccttaagctgataagcaacttcagcaaagtctcaggatacaaaatcaatgtgcaaaaatcacaagcattcctatacaccaataacagacaaacagagagccacatcatgagtgaactcccattcacaattgctacaaagaataaaatacctaggaatacaacttacaatggatgtgaagggcctcttcaaggggaacaacaaaccactgctcaaggaaataagagaggacacaaacaaatggaaaaacattccatgctcatggataggaagaatcaatattgtgaaaatggccatactgcccaaagtaatttatagatttaaagctattcccatcaagctaccattgactttcctcacagaattggaaaaatctactttaaatttcatatggaaccaaaaaagagcccacataaccaagacaatcctaagcaaaaagaacaaagctggaggcaacactggagttacctgaattcaaactataatacaaggctacagtaaaacagtatggtactggtaccaaaacacatatatatataccaatggaacagaacaaaggcctcagaaatatcaccacacatttacaaccatctgatctttgacaaacctgccaacaacaaacaatggggaaaggattccctctttaataaatggtgttgggaaaactggctagccatgtgcagaaaactgaaactggatcccttccttacaccttatacaaaaattaacccaacatatattaaacacttaaacataagacctaaaaccataaaaaccctagaagaaaacctaggcaataccatgcaggacataggcatgggcaaagacttcatgactaaaacaccaaaagcaatggcaacaaaagccaaaagagacaaatgggatctaattaaactaaagagcttctgcacagcaaaagaaactatcatcagagtgaacaggcaacccaaagaaagggagaaaatttttgcaatctatccatctgacaaagggctaatttccagaatctacaaagaactcaaacaaatttacacggaaaaaaacaaacaaccccatcaaaaagtgggcaaaggatatgaacagacacttctcaaaagaagacatttatgccaccaacaaacatatgaaaaaaatgctcatcatcactggccattagagtaatgcaaatcaaaaccacaatgagataacatgtcatgccagttagaatggtgatcattaaaaagtcaggaaacaacagatgctggagaggatgttgagaaataggaatgcttttacactgttggtgagagtgtaaattagttcaacaatggtggaggacagtgtggcaattcctgaaggatctagaactagaaataccatttgacccagcaatctcatcactgggtatatagccaaaggattataaatcattctactataaagacacatgcacacatatatttattgtggcactgttcacaatagcaaagacttggaacctactcaaatgcccatcaatgatagactggataaagaaaatgtggcacatatacaccatggaatactatgaagccatataaaaggatgagttcctgtcctgtacagggacatggatgatgctggaaaccatcattctcagtaaactaacacaagaacagaaaaccaaacaccacatgttctcactcataagtgggagttgaacaatgagaacacatggacacagggaggggaatatcacgcactgtcaggggggtgcggggctaggggagggatagcattaggagaaattcctaatgtagatgataggttgatgggtgcagcaaaccaccgtggcacgtgtatatgtatgtaacagacttgcatgttccgcacatgtaccccagaacttaaagtataataataaaaaagaacacatctagtagagacagtattgacttatcaatagacccagaaaaaatgtttaaattaaattttggagatgtgtttattttactttatcagtagttttaaaatcagccgtatttactaaatgttattaaagtcatgtaaacttaaaaaaaaaaaaaaagaagtcccagctgatgaggtctcagctggtaatgaggaacatactgggaagtggagtgatggcaacccttgctatgcttaagcaaagagactggtgacattttgttcctgccctagagatctgtggaactttgaacttgagagagattacttagggtatctggtggaagacatttctaagcagcaaagcattcaagaggtgatctgattgtttctaaaagtgtatgttcatatgcatgaacaaagagattatctgaaattggaacttaaaaggaaagcaaagcataaaagtttggaaaatttgcagtatggccatgtcgtagaaaagaaaaacccattttctggggagaaaaatcaagcctgctgcagaaatgtgcataagtaaagaacagctaaatgttaatcaccaaggcaatggggaatatatctccagagcatttcagagaccttcagggaagccctctcatcacaggcctgcaggtctaggagggaaaaatggttttgtgggcgaggcccagggccctgctgctctgtgcagcctcagaacacagtgccctgtatcacacatgccccagctccagctatggctaaaggggccaaggtacagctcaggctgaggcttcagagggtgcaagccccaagcctcagtagcatctacgtggtgctgggcctgcaggtgcacagaaggtgagagttgaggtttgggaacctccacctagatttcagaagatgtatgtaaacaccttgatgtccaggcagaagtctgctgcaggggtggacccctcatggggaacctacagtagggcagtgcagagtgggaatgtggggttggagccccagtatggactccccattggaacactgcctagtggagctggcagaagagggccaccatcctccagaccgtagaattatagatccaccaacaacttgcactgtgtgtctggaaaacccacaggaactcaacgccagcccatgaaagcagccaaggggcgtgtaccctgcaaagccacaggggcagagctgccaaaggccttgggagtccagcccttgtgttagtgtggcctggatgcaagacatagagtcaaaggagattattttggagctttaagattgaatgatggccctgctgggttttggacttgcatgggacctctagaccctttgttttggccaatttctcccatttgggatgtgaatatttgcccaatgcctgtacccctactgtttcttggaagtaactaacttggtgttgattttacaggatcataggtggaagggacttggcttgtgtcagatgtgactttggacctggatttttgagttaatgctagaatgagataagagtatgggggattgttgggaagccctgattgttttggaaatgtgaaaaggacataagatttgggaggggctggggcagaatgatatggcttagctctgtgtcccacccaaacttcatgttgaattataatccctgcatgtcagtggaggggcctagtggaaggtgattggatcacaggggcagatttcccccttgctgttctcatgatagtgagtgagttctcatgagatctgatggtttaacaacatgtggcacttcccccttgactctccctctctctctctctcctgcccaccatggaaagacatgcttgctttccctttgccttttgccatgattgtaagtttcctgaggcctccaagccatgcttcctgttaagcccatggaactatgagtcaattaaacctcttttcttcataaattacccagcctcagtctcaggtagttcttgacagcagtgtaataactgactaatatcaacttgcatatgaccattttgtcactggctaaaatattaactatccagccctttccaagaaagaggtgactgaaccctgatgcagaatgatgagtgtctgagggacaggattttagagcaatttcttttaacatgtattttttcttggaggaattccatcctaggagtaggaaaaaaataccgatgtcaaaagcaaatctaataccagggctttgtacactgacagatccaggatccctaattacagattctgatttttactttacatttactgcagcagatatctctgtattcaacagattccatttgttaataaatggaccaatcactacaaaaagcacatgatccctattgatcttgtcaatgaataatagaaaagtaaagaaaagaaaggcaaagatgaaagtgggaaaggtccttcaagaccacctgagcagcatcattcttcacaggtgagaaagtgaagcacatctggacacaggacttggcccaggtcacacagcccttgcagaaccaggactccctcagcctgaccccgtgttagtgcctatgtccctcaacaggaccagggttactattcataggagaagctctcacttggccagcctcaaattatatcaaggatgacaatctaaaaatgacatttgaagtccagtttcctacattaaaaatatgcagtgttcaatacttcagttattttggtacataggcaaattggatacctctgaaattaacagaaacaagaatttgaaaaaccaaccaaaatttttacatggaggactctcaagttaaccaggcttgctaagatgagaacatcactgacaacagcaatactcacccaattgtcttcctcagacctggaaggaaattgttccaattatgaataaaatgtaacgttttagcaaataacaataaataattgtatgtgtatgtgtatctgtgtgtatacaatttaaataattcctccgttaatttaacccaattcttcattaataatattagcatgaattaagaacttctaggcttgagaaaaaccactttaaaagtctcatttaagcttcataataaccctatgagttacaaaccattatcattcttactttatagatgagaaaccaaatatatttatattactgaattaagatgagttatcagaatttcatttctaatatttaatgatcctggtaggatggaaaatacacaaaaatgatacatcagttactgtactttgataatgtatctttacttctataggaataaaatttccattttccctctagcacagaatttttctcttctataatgtaaataccttcacttcatgcaaatacctaattcaatccagccaagaactcccatccaaaatgttttccctataatttttgtatatatttataacagtggtccccaaatagggatagttttgcccccccaggggacattcagcagtgtctggagacagctgggaagggtttgctactggcgtctagtggatagagtccaggatgctgctaaatgtcctatgctgcccagggcagcctacacaacagtgaattatctagcgtaaaaagtcaactgtgccaagacggagaaaccctagtttatatgaaaagcaaatcccatatccatattattttattgattatctcttgacttatggactaacagggttcttcagggacaatgagaattatctggattcttatagacccccagatcaccaaatagggtaaggcaaatcgggtaaggcaaatcatacaaactgattaacaggaaccaagagatactgctgtccaagaccggggagaagacggcatgctgtgactaatggacatcagtcaataatttcataacctctttgggatacaggcactttttttttttttttttttgagacagagccttgctctgtcacccaggctggagtgcagtggtgcaatcttggctcactgcaacctctgctgcctgggttctgcctcagcctgtcacgtagctgggattacaggcacttgccaccacgcccagctaatttttgtatttttagtagagacagggttttaccatcttggccaggctggtcttgaactcctgacctcgtgatccacccatcagagcctcctaaagtgctgggattacagacgtgagccaccgtgcccagcccaggcaccttttaagtaaagcgagagacagttcagtcctcgtttccttccacctttaacacaagagcatcatggcagattagttcaaatcttggagcaaaaatatgaaggccaaacacttaaaaaatgaataaaaataaaattacaaaaacacaccaaatagaagaaagcaaaatttaaaacaaatgaagcaaagaggaagttgattggaaagacatgaggccaaaactgattcaagcggtgagtcctgtgaacatgggtatgggccacatatttgtctctgcggttttcagtaatgaaagagaagaggatgtgggatttctaaaggcagaatcctggaaaagcaataacttgcccattcctaaaactttcaaccaatgtaatgcacatgtacaaaatgacacactcctctctgaaaaatgaatattaaggaaaatgagcattatatgacgtatatttatacctaaatcctaaatactttttctagaaaataagaaaaaaacagtataatctcagaggttcacggaggcatcatgcactttctggcagttgtagctgaccagacggataaagggacccccaaacagccgcctcccgtgtcatcagattgctctaaaatacgtaattccatcttctcacatgtgcacctccccatcccacagcatcaatcctaaattcctagtggtaggcaaagtagagtcccactttctaatccttaaaacctgtgaccatgttatgcttcatggcaagggggaaagtttagattgctggcagaatgaaggctgttaatcgattgagccatgacaatcaggtagcttgtagaagctggaaaaggcaaggaacctgactctccatagaagagcctccaagagggaaccagacctgccaacaccctggcctaagcacagtaagaccaattttgaacttctggcatccaaaacggtaagataatcaatgtgcattgttttaagccactgagtataggataatttgttgcagcagtatcacaaaactgatacaactcgttttagtttccttttgctgtctaataaattgccataaacctagagccctgaagcaatacctatgaattatctctcagttctcatgagtcaggagtccattcgtggtttaaccagatcctctgtttagaagctcattgtcctgacactgagatgtctttttaggcttgtgagagtcttctaaactcattggttgctggaaaaattcagttctttgtgactgtaggactgagacctcttgatactagggaatgcccacccctgtctgccctgtggttctctccacaacatggaattttgcttcttcaaagacaacagaagggcacctgctgtggcccttttaaagacttgcctgttaggtcaaatccactcaggatgatctcccttttgactaacctatactcaactgattagggttcttaattccatctgtaaaatccccttactcttaccatataaggtaaattaattatggtcctgctcacattcaaggggaggggatgatatagggtaggtccaccagggggcagaatcctggggccatcttagaattccacctaccacactccttggctgggcaaagtagctactgtaccagtttgcctctgcccgttaatttttaaccaaatgccccaacacaggcaagttagtaaggtttgtccactgtcctggacatgttcagtattagatacatagaacatatgcaaatgctagcatgttcctctctctccagtgactgttcccaaacttcaccttattttcatgattgcaggacataacacagaacccgaggtacatggacttaatcactgtacatctccacgcatgtgatacatggtcttactaaaaaatagatagatagatagatagataacagataataggcagatgatagataacagatgataaataaatatcaaatgatagataacagatgatagatgatagataacaggtaatagatagatagatattagagagagagagagagagagagagagataagagatagatgctgtctgtgccaaatttttttcttgattgaatactctaattccaaattaggagattgcttgatcaatttccctgccaatcattcctccacaggtaggcaatcaagggttccaaatgaaagcatatcataatgaatatctaacacagtagcaatttgcagtagactataaaacagtagctaatacagaattctgagagaaactaatagtgacaaggagaaagcaaaagaccttcagtttcataatgtaaactcaaactcagatttgcttgcctgaaaagtatcaatgtaggcacatcctgaatgaattatgtagagaaggcaaccgtttgggagttaacaatgagccagcatataaggaaagatggcaacataattacttccattccttttctataatggattgggctgattcaaattcaacatatttcatcaattttttttttaacaatcacaagtgatggtatttttccctttatttgctaactcagtaattcttttggggggtaaaattttgaggaaatcacaaatgaaacaaaatccctgatcatgggctaatgcagacctaagatgtttttgtataaaattaagaacagccttcgtatttcttcttgcagtttttagctggaagaagcctaccagcacaaaaaggataagctttaataaatagctctccttgtgataatgtagcacacattgcttcaattatagttctattctagtactgggggagggaaggatccgtcctggcagccagaaccctgcccaagaaaatgtgatgataacacaggaagggggcacccccttagccagccagataaactctaccagtctgaggcagacttcccagcaagaaaattctcacatcctcctattctaataatagaaccaaactagaggaagggaggaagaaacatctgtagttgtgtgctaaattcctcaagcctcctacactttttgagtcccctccctttaattagaagcatttatgcgtcattccacagtctctttttccttccaactatcgtctagtatgtcttctactctacaaatgatttctaacatttcttgttacaaaatgttcctgtgtggaaaatgctaatatttcatgatgcaactgacccaactccacagtgcagtgtaggattctgcaaacaccatcttgttattctccgtaaatatccccctttccttcttctggagaaaatctcaagcttcaatcactgggccgtgaacccgccaagacagtggcctttgagtcagtttgaaagaacaaaaatgcctagagcccttcctccccaaagaaacatgggattgacaagaaactctttagtctctcaacatactaacatacaaattaaacacattgtttaacacaaactatacttgccccattaaaactatcagtcaaaagactcagaactagccaggcttggttcttctccaagccagacttaaacaccagctcacaagttcccacaacatctgtttctagatgcttgatctatctccctgccaatcattcctccacaggcaggcaaaggtgccttttgaagcttcaaggactgatctcaggagcataggatggagaacacactctcaaggagatgaaaagcccttttcaagccatgagggtgacctcctataatgaccttgacccaaatgttctggtgatggctgcttcatggggagcaaaaggaatactgtcttaataataatttattgtctatttcaaaatacgcagaaaaatagatttataatgtttctgacacaaagtaatgataaatggttgaggtgatgcataccccaattagccagatttgatcattatatattgtatatgcttgtatcaaaatactgcatgtgttccatacataggtacaactataatatatccataaaacttttttttaaaaggatgcttcctgaaaaactgaggcaaactgcactaagtgatatttatatctttgtataacgctgcagaatgctaggagttcgttccaccatattgactaaatatacttgctaagataaggtgtaacgattccatctttaacattataataaaaagaaacacccgggagacttcttatgagcctctatttgataatatgccatgtgtattatatatagttgggttacttttaactgattttaacaacataaaggcaaattttcaagtaattgcaatgttttaataagctaatttttaaaatttatattatatgaacttttttcctaccattgattttttcccccagactctgacacccctccgtactcttttttctatctcccggaccatattaataaggttcagcaatcattgtttgctgattgagtttgacttcccatgtaatgctttgggcaacggatatttgcatgcagagaaatgtggtcctctccttggctcaccacctcactgccaggaaactaccccttcaagagctgactgaccagggctggacagttaactcactcctccagtccaaataatatgttccttattcatatgtttttattcaatcattcattcatattttcataatctctctctcccttacacacacttatacacacatacacacacacacacacacgtgaatttttataattaagtatataaagactgaaaaatggcaaattcatcttggcaaatacccaaagtaaagcccatcagcagagaataagaaacactgagtgataagatagctgagagtcccctgagatcttggccttgggccgggctccttctgcaccttggaccagaactggctttggactcttcaatctttgaacacatttccttttttagttgcaggcaaaacaatcataagcaaatgctgtccgtcactgttttcctacatgtacccaatgcattgagggagataacatacactcctggggtggccaggaatgcagaggaccagaagcgaatgggtcaattagccactaaccctcccccgtccacctgcacttcctccagagacataggcaagtgtgcacttgagcacaagtacatgcacacatgtgtacgatggatacagacattcatctttatattaacccaggcagcagcatgatccgaaaaatgccatctatattaacatcatcagctagggttaattgaatatctgttaagtaactttggtgtcagcaaaagtatcaaattctatttttagacatcacataatacaatagatattattcagtttaagcagaatagacactacatcctttcatatatacataattcctaaagctgagtatttctttgtacattgcaattatttttagaggaacgtaactaaaacttttccctaaatatgatttaaataataatttaaatgtcaaaaatattttaatcttatccattgcaagaatttataatttataaacctttaaaaattatattcttctgaaataaattatatcaattttctaatgttatgttaccctagtacaggacttggcaaactatagtcagcaggccaaatcaggcctaccacctattattataaataaagttttattaaaactcagccatccatattcatatacttattgtctatagccggctttgtaccatcatggcagagttgatgagccataccagagatcacgtggcctgcaaagtctctgcatttactatctggccctgtacagaaaatgtttgcaaagtcttgctctagccaattatggcaaagtaacttaaaaattatttccctcaagccctaatttttaaaaaataaaatgtcatcatgttcaaccaaactcaatagattctgaatatccttccagatattctgaatattctgaataccagaatagtagattctgaatattgctgtcttcaaaaacacttatggattaagaggataagcaagcaaatgtataagataaatgtaaaagagacacatgacatatctaaaatagaattaaaagcacttcacaaaactgggaaaatattaaaatatgttttaggatactttatgaatcaagggttctataggaattacgtgacaccatcacataagataatttgaagaaggcttgacaagacaactatcaacaaagacacaggtgtggaagaggcaaacacaagagttcccagtggctactaaggggcccaaaggaatgctgggggataaagggtcataaagggagagccaggtgggtgtggctgctgcggtgtgaggccagggccacagccagtcccaggtaacccagtggcagccagtggtgggaatcgcagctcggacttccctcccctttctcccacaggccttccaaggaccttttccatggccctatccagctggccgcgagagggcacaggggcatgacagcagtcatagaagcttcccagtacagaggcagaaacagacgctgggaggggcaagagaaaatagccagcaggagttcactttctttcgaagatgataaaacaggagaaaataaatgtgaaactgttctctacagtgtttatatttctagccaagaacactctcatgaatgaaattcattttctaaaattagggcaatgctaagaataagtcttttctccaacattaaaataaaaataaatttaccaaaaaatggttgcataatgaagtggctggaaccaaaatgtagtcttggtaagattaagcccacagtagctaatgtacaagttgtaaactatatctcattcatatcatgttgatatttgaaagaagtagaaatgaggacacacaaaaaaaaggaaagcatttttacctcatccttcaaacaaaaacaaaagtattttttctcccaaaatgatttttaaattaaatgcttcttttgtcagaaagtgaatcctagcgtagtgacattgccattgatggtttaagcctattagagacctgtgttgctcacgaaacatgttgaataggactctaacagtattttcacaaatgtttttctcccacatcctcatcaatgagatctggcatttacttccaatcagtgtatatgtcttcatttatatattataaacacatacagctgtgcatgtatataagtatattttaaatacagtatacacatctgaaaataatgacatcaagataaaatgattgatattataaagtaaatattatgttatagtctgatttaacaaaactttttaaacttagtgcaataatttatgatagaatgaattaaaattctgttttctacattcaatttatattaatttttagtttaaaaacttctataactgaagtggacaactcaaacagatatataaatccaatttcttgggaggctgaggcagatcgcgaggtcaggagattgagaacatcctggctgacacggtgaaaccccgtctctacaaaaaatacaaaaaattagccaggcgtggtggcacgtgccggtagtcccagcaattcaggaggctgaggcaggagaatcacttgaacccaggaggtggaggttacagtgagacgagattgcgccactgcattccagcctgggtgacagagcaagactgtctcaaaaataaaaaaaaaaaaatccaattacatcattggctgtttttaataaattttgatatactactttttcaacttcatctgccaattagacaatgttttttgttgaaatttgccaagcacattttcatcttcactgatgtcaatatcttgtgctcaaaaatttatcagaaagattaaaaaatgagcttaaagtccactgaaacttcccttttgggagttttaaaaaagggttaaaagtacacataagacatttcaaaagtgaattttctaaatttatatatttaaaaatcaggtaagattgttattatagtgattgttgagcatcatcattaacaaccaattcacataaggacagaaatcttctgaggtatctgatttaaaaattacttttaatttttttatttcaataggttttttggaaacaggtggtgtttggttatatgaataagttttttcgtggtgatttctgagattttgggggcacctatcacccaagcaggctacactgtacccaatgtgtagtcttttatccctcaccccctcccaccctttcctcttagtcctcaaagtccattgtatcgttcttatgcctttgaataattatagttaagcactcccattatgagtgagaacatatgatgtttggttttccattcctgagttacttcacttagaataatggtttccaggtccatgcagcttgctgtaaatgccattatttcattcatttttatgatatacatatatatacactacattttctttatctacttgttgactgatgggcatttggattggttcaatatttttgcagttgagtattgtgctgctatattgcatgagtttcttttggaaagcaattacggtctcattaattgtgaaacaagacaatttcttttctacaggtacctactattcatcatactattaaaaataacaggaagttcagcaaatttagatcccttatatcttaaaaaaggagaaataggtacatagagatgatagcgctagatatacagaaacattgatatatgtgtatatacatacacatccattgacgttaagcttcacaatttttcaatatcttaaattaatgacagctctttaaatatgttgccactaggtatccagagaccctccctataaaacagaaaataatggttctttcccacctcatttcaaaacattataaatactctcccatgttaaataacataacacaaaaatgcactttactggaacttgtaagtcaaaacccttccaatatttccctgattccctcaggatgccttagaaactcactttggcatgtgtcagagcttgacatattgagcaagtgaggcaccagcatcaacttacattttaatattagtacattttacattgctgtggtataaacattctagaaacagaatttcccattttctttccatccgtctcttgagatcactgctattgactctagactacctgcttcagaatcacatttagatgtttgctaaaaatggtcgttcttggccactggagtcagaatcaatgagaagtggagtcacaaaacccagagtttaaacaagttctggatgcggcagattttgcacttcgcggatggtcccagcagcatgtcccccacaggctctcctgcatgcaacctgctggtcatccatccacaactggagtctatttctctaccaccttggattctggaaagcctaactcctttgaccaataaaatatgaccgaagagctcctttgccagttccaggcatggccttaactggcctggaagcttcatttccagtctcttgaaggcaggtgccatgtaagaagttcagccatccagagaccaccatgttaggagagaataaagagatgacatggtgggcaaaatgacaaatggagaagaaaggaggatgtagaagcaggaaagagagagagagagagaaagagagagagagagagaaaggagacagagacagataccaaggagcaatggcatgcagtccctgtgagtggatcaaccaccttgaatatggaacctccagtccaagcagcctcatctgatgccaacacaatcataaacaaacttctcagccaagttctttttttttttttttttgacttttggaattttggaattttggaattcctgatcaacaaaattgtgagcaaaataaaacggttgttttaaatcactatgttttgtggtgctgattaggtagcaattaataactgaaacaagaagtcattattttgctacaagtaaggatgtctagtcaagattctctccctgcccatcccaagtctccatacaggaagccccattcccctacctgggatttgcggtgaggctgcagccctagaaagatggctggctgtcacccctgcctcaggagtcctcgaggctacttttggtcaacactataactgaagcagaagcaacagtggcgtttagaagatgtcaaacatggaaataatgacttcttggacttatacaagtatttaaccctcctttccctttgttgaatgcctgacatcccacgtttgtaaatcaattctgtgaatcctccagcccatttatggtccataacttaaattgcatcaaataatttcaaacacggtagttaccagtatatacttgatttataaaattcacagttataacaatatgttaactcgtttactcaatctaaaaccttaaggaaaacattactattattcctgagagggaactgaaatacagtgagattaagtaacttgcccgaggacacacacccagtaagttgaggcagtggctactcagatcatatatccccaaaccctcttcattactgtcttcagttattaatacagaaattgtagttaggatgtcaggtaaataaatggtgaatttccataaaccaaagggaatttacagaaatattaactattctaaaattctttccaagtttaaacaatcaattttcatggtgatttattcaataaaagctgcaaaaaaaaccatgtttgtttgaaaatacacactcaagtccatacaaagaaaaaaatcaactgtttagattatatgagtaattcaaaaggtgaagcagtttctattgtgtagaccagggtttctcaaccaggtgcgattttgcaccccagggaacacgtggaagtgtctagagacagctttggttgtcattactagtatgtgtggggtgtgctactggcatctaggggtacaggccaaggatgctgttaaacatcctacactgcacaggacagaacccccatgaccaagaattatctggcccaaaacatcaatagtgtgcaggtgcagaaaccctgatgcgaaacgtgatcgaggcgtttcttctgccctgatcatcctttcttgtggtcatctcctctccctgctctgagccttggtagcactgtttcatatcccacactgaataccttgtgatggcactgccactaccactgttcatttttcaggtccataaatcttatcttgtcaactggaacgtgagctgctagagagctctcaggtctctctctctctctctcctggaagaatgtagtgcaaggaggtggcatctgatatctttttgtcaacacggtttataatttctaatttcttgaatacttgaaatgaaatactcaaagccatccaggtaactgcctccttctgagaaaatgtcttccttgagtgtcttttacttcttaagggtttaagaagccatctcctcacccagggccatatgaaaaataaacttccctttgttttaatttccaagaggaagttatcaccaagggacacaaacttgaacttttgaacatggaatggtcaacattccagcttttatactcactgtatggacaatcagtaattgctgctttttaacagtaggaataaatctaatacatgttattaaattctgcatattttgtcacagtttgtgtttgtgtaattttcctttcatgcctgttgcacttgtgttatttgatcatctaatttctcttttacttttctttctcctcctccaaaatggaggcttatttacatcaattattgatctgccatatgtctaatttagccctatgtccagtacttgaactagagaaactgttaaaccaaattagtaataatgtttaggctagaggtggaggggatattgggtaggtactttttgcaaaagtgaatacataattaaataaaaaatagtaatactgttggtggccacattagctgtaaactaacatagagaaaagaaataatgagcaattggttcctttctttgtaagatcccaattgcagtccatacagttattctccatgacttatcacagggtagtccctctgccaatagtggtataagtgaattgaaaacacattacattttaattaatcatttaattaaaggaaaaagagagacatgaaaatgaaacagggaacaaaagctcaggtcacatacagcaatgggtgatctccaaatcttgtctccctgtctttgaaataagaccagacagcatttggccttccggtacatcgtcacctcccctctcagctcggctgcagccactcaaggtttgggacttcaaagtgccatgactcctcataggcattaagcctacagtataagccccagcacccccaacctgcctcactctgtggacttgcacacaaccatgggccactttccatccacatcatcaaagctgtccaaaaatggggcaggggaccctggccttcgtttcaaaaattacagttctgccagatgccacgagatggatgctaaaaccctgttccttcctggattcccctgcctgctcctcacacaaatatggatgtcatgcctctttcatgtcaacacctattgtgctgaactctacacttggaatgtctcaatacctagtgctgtccttataccttgacgaaaactctccctagatttactgagcactctacttgcttaaccactcagaatccaaacacaacatatgtcatctgctttgtccagggaattggacttctaaacacttcccccatggagaagataatccactcttcctttacactgagaggtctcaatgaagaaatggcttccaaaccagccaataatccagccccattttcacatctacctgattcaacaattcattcattcattcattatgtctctcactcattcactttcacttggtctgttttcctccttcatccctcccctccttctcttccaccaccagaattctcaattagcctttcaaatacccacaagaaagtcccactgtaatcctcaccatcactcaaggtcactagcgccaaagcacaacttcctgtcttccatccctataactggcctacacatccagaccctcaaaacccactctccctgctactctccagtgcttctgggatcggatacactattttcatagcccctgtcagggtccattcccacaaagtatgactcacaacaggctccagagctctagtttcccagggttcatgttcaaagtagggattcccgctaccccaaattcttattcagtaagcataaaaaggatttggggatttccattattaaaagtccatttgggtgaatctgatgatcaacagattctagaactcctgtgctcaaaagacagtaagcctctcatcctaactgccttttgtaatgctgatgctattgacagaggcagtgcctaggattaaactcccctttgtgagttggaattctggtttgcaaactccatctacttttcaaaattaagtgaacaaagagaaagatgggaagccaaataattcacactgaatgtttgaatcttaggctgggcagaatttgatagttgtctaggtggtacatgggagtgactggggagaaggacgagtgatggggaaggaggaggaggaggaggattttctactcttcagagcttatggcagaaagttatcagcatgtgagctggagccaggtggtctgagagctaatctggaatgcaccaaggctgcagatacttgatgctgacctgatttcctcatgcaaaatcaggataaagatgatacctatcaaatataagcactgataagattaaatggaataatgcatgctgagctcttaccataaagctggatataaaataataactcaatattagctatgatcatcattatatgcataagatttaggaaaacttaacctctttattttgttatatatcttcagagaattacattgtacacatccagacgacctgagtggaaatcattgttctcatccaaatatcacccaatgctttctttaattctaggtagaataatcaaaaaagacactttgtctccatatgccaaataacagccccaatcagccagtggaacaaccagataattacttatcaactaaggggtattttaatgtgatgcatgataactaaggacttaaaatcacaaatacaatcatgccaatttttaaagggatgtgtaattggggcaagaaaatagagagttgaaccccacagaaggaaagaaatagaatctaaaaatatcagttattttaaaagttcaataaaggctattagtgtataaaatgtataattaatttactatctgtatatccgtttacaggcttatcatatctttgaggttgatctataaatcttcaaatatattaattatatttaaccagctgtggtaaactgcgatttgtcaaaaactggtaaaacactgttttctttttaaagcagctaaatgtaatatatttataatgagcccttcttgcatcagctataagtacatgatgtgacataatttataactataaatatacattttatatgtaaatagaaaagtctctgtattctatttgaaatactgtacttttcacaaatgcattgcttaacaattaatgtggtcaaatcttataatgccaaaatgttttttaattatgtatttcatacctttatgctcaagcttaatttggttacctgttattctctaattacaaaaaggaatcttcatttaagaaagtcttggaccaaatataaaacatcattcagaaagcaggccggtcaaaaagtaaaagcttatggtttctaaatttcaggatttctttatgaaaaaatgtcttctgtagtattttacaatttttaaatttcaggatttgtacaggcagtagtaacaggcaggaaaggagggtaaggggaaggagaaacagcatatttcctacaggtgagacattatgctccaaactgtgatctcaaaaaaaaaaaaaaaaaaagatataaaaacatttccttagggagctttaatggattactgagttactatgggcggaaacttcttgatctctttctgggagacaaccaaaaaggtgcagctaaagctcagagaagaaaatcagcatggctgagcttccattatgagaaaatacatgaaaacagtattggatggtggtcacccaagaaaatgcaataatagctgaatgttggaaagtgacaaattcaacctaaaaaaatacatatatatatacatatacatatgtatatacacatacatatgtatatacacatacatacacacatactttttcctaagttttttttctatcgactcaaatatttcacaaagggggaattacgcctgcaggagcacatagctgtggtgtgaatgactgtgtcctctgagaaattcatatgttgaaatcctaacctctcaaggcctgcaggtggtgattaggtcacgagggtgacaccttctgattgagattagtgccctgataaaaaaggaatcagagaactcagtcagtcgccacttccactatgtgtgtgccctcagcagacactgaaccttcaggtgccttgttcctggactttcaggccttcagaactgtgagcaataaatttctgttttttttgtttacttgtttttgagagagtatctcactccaattgcccaggctggagtgtagtggcatgatcttggctcactacagcctcaacctcccaggctcaaatgatcctcccacctcagtctcccgagtagctgggactacaggtacatgccaccatgtcaagctatttttttttttttgtatttttagtaaagacagggtttttccatgttgcccagactggtcttgaactcctgggctcaagccacctgcctaccttggccacccaaatcactggggttacaggtgtgaatcactgggattacaggtgtgaaccaccatgcctggccaatttctgttgtttacaagttacccagcctagggtatttgggaaaacagcctatataaactaaaacacacacaaatacacatagagttaaagaatatatagctataaagttaggtgaccaaaatgtcctctagtcatcaaaaattatactaatgtcattatgacttgaactgtgtcctccccaaaagatacggtgaagtcctaacccccagtacctaacaaataatctcatttggaaattaggtttttacagaggtaatcaagttaaaatgagatcattagggtgggccataatccatatgtgtcctatgaaaaagggaaatttggatgctgagccagacaagcatagaggaaagaggatgtgaagacatgcaggagaagatggccaaaaggcttgagtggtgatgtgtgtacaagctgagaatgccaaggattgctggcaaccacctgcagctaacgaggtgaggaagaagactcccctagagccttagggaagaatatggccctgccaacacttgattttagatttcaggcctccagaactgtgaggtcatccatttctgttgtgttaagccacctagcttttgtttctctgttatagcaggtctaagaaactaatacacatgcgtagaacagaagtatcacaacccagtcctttttttatcttctaagtttttttaaaagttctctcctaaataaacaaaaatacataagtaatctttaaaacttacataggttaagtttctagtgctgtactgattggttcaattgttaagaatattgactataaggtcagttctgtctttgacatagagttttgaataaggagtttgatggaaaatatctgtagattaaggttctttttcaagactgtgatggtagctgacatttttgcagctttaaatatatactgagtcacatccttagtaaagaaggaaggtaatcgtcaaacattttaaaataccccattgttataagattttgaaataccattatcacagcatttcagtaatgaactctcacagccttcagctctgcccactgttgaagagaagtaatcagtctagatgcatacttcccttatggagcttttaggggcataatatccatccagttagtcatttggacaggcttgataaactaagcccacagtcaacctgccattaaaagcagagtgagttagatttgtggcatcctcagtattaattaaacattgatggtgggcatcactgttcagaagaagggggcatctttacctaatgtgcgcgcaaatctcaacagtcttagagctgaaagggcccttagagatcatctattcatctggtctaatcctgttggaatggggaatctcatattagaactgcgggtaagagagtaggtgaagaaggagcctggcattagaggggagactattaaaataatacctggcaggaattgatgtggatggagagtatagacagaagatgttcagtgtcgagcaaaagaaatagcaagtggagatgggcctggaaggtttgaattcagttggaggaaatcaagcaaacacccaggagaaaggcaagttggggatgatgagttcacacctatctcctgcaggggactttctctgagctgaccttgtatttttaccagcttccaatcttgggtggggtgctgaccagtggagtgggagaggaagacttggcagaaaatcttcactagtgacccaagtcaaccttgccagcgttgggctcagatgtcaactttaagcatcccttgaggcataaacttaggcagaatttgatcatttacaaacacctgtcatttgaacaggttttgggaaggaggccataaatgttaacacctttctctgctctcccaactgaaactctaaaatgccaaagaatattttcaggaaaacatagtgtgcttactccaaatggcacagacaaaagccatacttcacgtctccttccctgatggggccaggcctcagatatccaaatgtagctgagatgtaacagaagagttttaaggcccctcagtggccctgctctaatgagagccagaagttcccaatgctgccacctcaagatattattacagtactgaaatgacatccaaaacacgaacaaaaagaaaactgaaattctgccctcttgtttctcctcacttttttggggggcggggggcaggtcttgctctgttagactggggtgcactggcactatcatggctcactgcagcatcgagctccccagtctccagtgatcctcctgccttggcctcccatgtagctggacctacaggcacaccccaccacacctgactaatttttgtaatttttgtagagacagggtttcgccatgttacccaggctggtctcaaactcctgggttcaagtgatccacccgtcttagcctccaaaagtgttgggactgcaggcgtgagccactgcgcccggccatttctcctcatttctaatgccatgtcctgggtgctgaacaggatagtcccctacaacacagaattatctgacctacatttccatagtgctgagatgaagaaactctgagaaggagaaaaagaggatagtaatttggaacaaatcttacagccataatacaggagtagccttatgtcaccatgggtaggtagaatctcttccaaacaaagaggcataaacccaggaatattttcttctgaagatctcctgaatactacctgaattgggttgaatggtggcctcccaaaacatatatctatttggaacctgtaatggtaaccttatttggagaaaggatcttagcaaatgtaattaagaatcccaagatgacatcatcctggataatcctggtgaatcctaaatccagttgcaagtatccttataaaagaaagttcagggctatattagacacatagacacacaaaggaagccatgtgaagatggaggcagagattggagtttgaaatcaaagaacacctggagccactagaactggaaaaggcgatgaagctttctcccctagagtcttcaaagggagtggagccctgctgatatctcagtttctgacttccaggctccagcactgtaaaaggatagattttagttgtttttaagccaccaaatttgtggtaatttgttattgcatccctagaaagctaatacactactaaacagataatatgttcagacaacttatattctctctaatggccagaactgactggtttaaatgtgacttcagaaaaactttgacaactatattaacaagctaagtgtttctcatgagttacatgagctaaatgacttccttcaccaaaggtaatgtttagtattttaaacagaagaaagtcacacttggtatttgtatcacagacaactttctaaagacagcctcttatctcagagttgataaattttaggcagcgaattcataagcatcaggtgtctcaaaatgtgcaacgtcattgaaatctgtttcgagaagttttaatgtgagcagcagacaggagtaaaatcgtattacgcaagcccttcaggctctctggcaagtgataaaaactcaatgccaactaggttacgccaaaaacaaaagcacagattcaagcataaactcagggagtcaaagtatgctgtaagaattccatggttcttactcctagttacaatggcctctgttgggccttcttcttggaaagactccatatggtgacaagatggctgcaagtagcctgcacttgacgtcactctttgagctcatgattgcaaagaagaaattggtcttgcagctctcaggcacagtgcaatgtcattaaaggccactgattaagggcacttgggtcatttacagcactcaggacccagaggatattattctcttgttgggcttcctgggagacctgcccacctgcaatatatgagaaagaggagccatgcatattagcttcctgtggctgctgtaacaaatggccagcaatttggtggcttaaatcaatatgactttattctctcacagttctggagagaagtcagaaatcagtatcaatgggccaaactcaaggtggtagcagagctatgctcccctaggagggcctaggggagaatccatcgccccttgcagctctgagtggctgccagctttccttagctgtagttgcatcactctaattttcaaagcccatctcttcaaatctctctcaaatccatcttcacatggcttgctcctctgtgtgtgtgtaatcttcttctgcatctctcttctaaaaacacatgtgattgtatctaagaggcacccagataatccagaaaaatcttcccatttcaagatccttaatataatcacatctttgccatgtaaggtcacatttagaagtttcaggaattagatatcttttggagggccatttttcagcctactgcatgatatcactgacaatactgctcaagtcacagggagtagagtcctggcaatcccagaaaaataaataaggcactgacagatgcaccttacaggctaacgcatggatcatctctcagctgtctgctaaatacaatgacgtcattacagaactgagccatcacataagccaaactcaatctcatacttgctttacatttatggtggggctaaacaacagatagtggtagaaacagcacatttcatttcatgctctcattcatgtgttcattatgctcatgaacctggataattcacagctgtttctcagtgcaaatatgcaatgttcatcaaggcatgatctcagagcacaagcacctaagatgctataatatcgatattgaacacatctagacaaagataaacctttagaaattgacatagaaccacctactgtcacatgctagcagagtagggaactctgctgacggtgagaaagaagatacatatccattagttcaatgtgttttccctgactcatcttaggctctaaacagcaggaagaaaaagaggccgcttgacaaatactaattataatgtagatagaaatttcaaagccagattttttaattttgcctgttttctttatgaatcaatctaaatttattagcctttgctagtgctataagtcatgcatatatatgacagacaatttgggaaattatggtaaagtataaaatgaaaaatccaaaccactcaccacatggaaacaaccacttgctaatttacttatttcaaatagtaaatttaacttaaatacacacacacacacacatacacacacatatatatatataatttttttttttttttgagacagagtctcgctctgttgcccaggctagagtgcagtggcgccatctcggcttactgcaatctccgcctcctaggttcatgccattctcctgcctcagcctccccagtagctgggaatacaggcgcccaccaccatgcccggctaattttttgtattttcagtagaggtggggtttcaccgtgttagccaggatggtctcaatctcctaacctcgtgatccacctgcctcggcctcccaaagtgctgggaacttgaatatattttaaaaagaacttgaggatagattcaaagaatgcctgaacttcatatttcttcaccataaatatcaactcctaaaaacttcccaaaagataccattaattttttttaagtttacacacatagatacatgtttctttgtagcatacatttatgtttctaggaggtataatatattataaaatagctggaagagagactttcgaatgttctcaccataaagaaatgataaatgaatgaggtgatgaataagctaaatacccaaatttgatgattatgccaaatatatatgtacagaagcatcaattttatcccatcaatatgtacaaatacaatgtgccaataaatatttttaaaggaatacattaaaaatcacttaatcagaatccaaagaaacaaaagacaatccttgaaaactataagtttaacaaatcctatataaaatattttaaaaataacatattttgaaatttgagcttgcttttagcattaccctcaaagacatacagaagggaaacaatgagcatttctccagcaaaatattcccttttgtaaaagatagatcacttgttgaagaaaaacaaaatagacatggaaaattgattttatcatgaactataataaagcctgagaaattacacacaagtagactgtggtgtttatgttccaccaaaatttgttgttttcatttcttagactcaactactcaaaataaccctatttgttttataattggagcagttttcttggatgcctgttttctcttgtatacctatttatctttgttgtctatataatttccaatagtatttccatttttcttagtgataaaaataatcttcatataattaacactttctctttgttaaacttgtgatttgtgtaaaaaaatctacttttctcataaagtcatttttatagaatcttctaatttgttccttaataattttcgatgaactatgtctatgaaagaacatatccttattttttgtgaattctttatcgatctgatttgtccttttcatgtcagtcttttcatactttatgaatataatatcatctttatattatttttaaagttaaacatacactcaattcataaagaaatctgcaagatctaaaataataaagaaagccctctatgtcatacagcctatatagtttgcttaaagcaaaaactttcaactctttaactggtttatttatgtatttttctccaaatttgtaactaataatattttactgctgtttcttgatattttcagttagaaatattattcactggctcctttttactttatccctcttcctccatcaacatagatgcatgctccctcccccactttctcagtattgatttatgatgattctgtaggaatatgcagtacctacataactatgcaaatactcttcacagatgggccatgaaataagattttactacatcttgtttctcaaaacaattatacgtttcttagagttaataattgtctcttgtttttctatgtagttattatctttttgtcccccacaccgaaatgtaagtctcctttttgtctaaatgcattcaaacacctcagatatcccattattgatatcctcctggaaagatgccttcggtaactgtatcatctactccaacctggactggtggctcccaaggcccgccgcacaacagttccacaattatctccctttgccctcatcccaggaatatttttctccctctcgcctgtattggagcctctatttcctgggcctagtgtgttaaccattcatatatttcccttgatttttcatctcttagtctttattcaactttctgggaaatttttatcaaatttatttactaattttccatggatatttttatttctatgatcatatattttcaaaataatctatgaagccttttgaaatacactgaatatttcttttctccttgtttcatggtagtaatatcttctctaatttcagaagacattcatcataatttcttgtctctctgtcttccaagtttcttatttaatttggttcactctgtgtttttcgtaactgggaactgcaagaacattagagctgggcacccacattgctttgtagaccagccatcattgcttaatctgggtgggatttttttgtattagagtgaccaccgatgtcactatccttaaggttctagttgtaagctgattagataccaacaaaagtgtacgccaaaacccatataaaatatatgcaaagagaaacaccaacaccggggagaagggctaggatctcaatatacagtatatatactgtgtgtgtgtgcgtatatatatatatatatatttacacgcacacacacacacacacacacatatatacacatacatacatatacatatatactgaattctccccttcttttttaagggaagttctcaggggaaatcttggtcccctggtccaatatatcagcagctttgtcatcttccagaattgcactactgtcttcttccagcatggcagaggaacaactgtgttgagacacaaagtgagcgagcaggaagatctgggttctaactgcttcttccattgtctcctgagtttgtggtttctcttgaaaaactggctatggatcttatttttactcctctgaaggttatgtctttttctgttacttgattatttttaagatttatcccttttccacgagttttcagaagtctgactataacgtgctggtgtggttatctattgtatttgaggtttgcagagcttcttagtctgtgagttgatacctttcatcactttggaaaagtttcagtgataattaccaggcacatagcttctgccttgtcctcttccttctccttttgagactcaagttgtatgtgagttagagttttcaaggtgtcatgtgtgtctaatactcttttatctaccctttccaattcctctctgtatttcagtttgaatattttccacagactggtcttccagttcactaatacaatattttttttctgctatgtctaatctgctgttaaaataattcatatagttccatatgtcagatattatttgtttttaaaaaattatagaaaatttatttgattcttttttattctaatgttctggtaaaattctccactctttaattaatctgtctaaattatcctctactttcttccttatattaatcataattatttaaagttaccttctgctaactttactaactgtatcatctgtcactttcatcagccaagagcaactctccagaggaaggggcagctatgaaccagtatcaaacaaccctcacaatagccagggatagggtgccctgttctataaggagagctgggtagggtgtctcttgtgttcatagagattttcctttgatgtacctttattgtcacttaaatgctttattttaaatcaatgaaagaacagtacataggttcccttcatcttgaatcagaaactaatggctatggtttaaaattgcatttgattttgatgctcctttattcaaatggtgcttggcaattcttaggcaatgaattgcatgaggtcttcggactccagatattaccaaaattacatgtatagtcatgcctaatttcgtataaagcagcctattcttagtagggaatttctgcatgggcaacttgcctctgcgatctaagatgcatgtaaataataactgagtattgccaaaaattgaaagtagaattgaatttcaaaaattaaactgagcaaccaacccatataaaatcattgaagggatcatgtagtatcacttgaaaaagtggcaatagcccccacaacagtaagaattgatacaagcagattaaacattgtgttctaatgaagaagtattatataaactcttaaaggttagctatgagagcacagcaaaaggattgtttgtcaaacatatgttaaacaagggtgttgtccattgcagccctatccacaatgactctacccatctctgtgacagttatcaataaattctggatgacaaatggcttacatgttaaagagtcaacaaattaagggttccaatccatccactccagagagtggtcagccaatgtgacttttttttttttcatttatgtttctcctttgctttttattttcactttgttcttaggtaattgggagacagcttacagaacacattatctcttactcaaacaagaaatcattactaaaatttggagcaatgagttttcctggtatgttggcttatttatttttgttagcattttggaagggacatacagataagggaaatgaacacagggcagagaattctgagcatgcccatcactcagcagtcatggcacttatgggggccatttttgacatagaaggagaaatgcattttagataaatgaaatgaactcctccatttatctagcagcttgtgattgtcagacagtgtttgctattggattacataaattgcctgacttcgtttcatgaaactaaatgatatacatgactaacaaatatattcatgcatcttcaatttagtttttgaggccacaagcaaagcaacaatttagaaatggataaagagagttattagaaattaagatatgcacaacacaaaagaatgaattcaataataaagtatgtacttttttgtcaaagacataaaaacacttcatttcagtggcagagactagtgtctgttcggtcagagtcaggaacatcaagaaaactctaagtaagatacctaaaagtattgagtattatcaatcatagtgggtgctatcggcaccccatccagctcttatgaaacaggacactgtatccctggctgctgtcactgttagctgatcctggttcatagcttcccaactctctggagaattgctcctggttaatgagagccacctcaccaggaagttatgtcaccaaacactccaaatgtggcagccgaagaacaagggagagttggttataaatcgccacagcccttgcctcaaatgggattaacagcggttctatatatgctctagagctgcatctgggatcgggttgaggctatactccagctgacaggaaatttttgcctacttcctttctttgctatgtcacacactccctaccttttgagagcatgccttaagtaaatcacatgcttgagaacccctatctcagactgtgtttccagggtaccaaacctaaaacccatatttgaatttcaattaaaaattaacggttatattcactgtaagccagatgtcaactataggtcgtatgctggccagtacaaatgagtacaataaagcagcaattgtcctctggagccctacacacccaggtccaaatcctagctctaccacctatcagatggctgatcttggctaaatcacataaacttgtagacctcaactcctctgctgttgaatattgaaaataatacccccactttagtgctgctggagaactcgatgagatgatgcttgcaaagtgccaagaacagagtaagggcaggatgagtgatgcctgctattatttttgttgctgtcatcatgatttcatgacaaattaggtcattaaagttacatcaaataagcataatgccaagtttcaaattagtagggaatgttttccttaaacaggagttcaggcattacttaagcaagacagaagaaagagtaagtggaaggatgatgcatattaaaaatttaatcctggcagagaattcagggataaatccagtgtactcttcttcctggctgtcctctccaaaatgtactatagagaaaattgaggtaaagagaggttaagtggcttgctcaaagtattcctgcttgttatttacagaaatgttagaatcatgaagaaatctgttggtacgtagcaaaaaaattagaatggtatggcggggtgggatgagggtagaacagggaacagttaagtgtatccccaggggccggtcttgttttccctagcacagactaggagaaaatgctaatatctgtcaatgtctgaatgcatacaaaccacatatcccaacctgccttgtgatttcttgaagttatgtgactgagttatggccagtggaatttgggcacaagggatgcacttcctggcatggcatgatcctttgcatgatcctccactcgaatttgtctttcttccctactgcctctggaggcatggattgaagacgggataccataagagaacactgtgggatcctgaacggcagcatggaaccaagccccacagactgcactggactcacttgcgagggaggaataagtcttctgcatgtgaatgttcagcttctaggagggcgcagttgttttaatggcagttaacttggttcatattctctgaaactagtaaaatcttagtcctcatctacataaaatatacataatcaactataaatcttccagaacgttatttaaaaagtagagtaaatatgtttgaataaatcggtatataaaacagcatctgacagaaaatcttcaccaagggaacagatataagagcctagaatctgaggaggaccgttggtaacgctgtctcaggttaccaacttctgggtcaagatcaactggggatcatgtaattattacacagcgagtccaaataaacacagcaatcaaacattgataaactaaaaaaaaatactgagtcatattgtgttcactcatcaattcaggaaatattcattgagaacttgccgagtactaggtaccataataggtgacaaactttttcttaaaggaagagagagtcacatagtttatattttaggcttggtaggccaggcagtctctgtggctactggtcaagttagctgaacagcagccatagatgttatgttaaaaaaaaatgaacaatatgtctggattccaaataaaacttcattaactattattataggccaacgacatgcaaatgaatggctatgttccaataatacctttactatgatcaacataccttagttgttaactcctgaaagattttaataaaaataatctttaaaatccacttctatgacaataagaacatatgacaaagataggcaaaaaaataaatgagctcagaatcatgatttttgagagctgtgggggagaccagtctctccttgcccaataaatataaaacataatttaaaaaattaatcattgtgaatatctcattggaatagttattctaaattattaattaatatatcatgctttaaattatacagaagaattccaacagagggtagttatattatagtgttatgacccattagagagggtattataaattgcctcaatttatttttaaatttaatttcatattaataaaaggaagtaatttaaacacaagaatcccagcagcttctttagaactggcaactaaagattcatagtttgcatatatacatatatatatatatgaacacacatatgtatatgtgtatatatatacacacaatatatatattgcatatataatatatatatacatgaacacacatatgaatctttagtgtttagatttcttcatatgtggagacatatatattcaacatatatacatagaaatctaaaccgaaaaattccctaagcacatcaaagatcttatatgttcaatcaagtaatcttaatatcacagattagaaaatggcttctttaaaacatgtggaaactgaggcaacaatcaaggaacatagggtttctcaacgttggcactgttagcattcagagtcaggtaaatttcgctcaacgggggggtcctgctctgtgcattgtagaaggtttggtaccacccctggtctctacacgctagatgccagtcaaagcttcccccaccagttgtgacaactaataatgtccccagatattgccaaatattcccagaaggtgaaattgtcggaagttgagaacttctagtctaaaaattgactcacgttgaaactcaatccccccaacccagatatacaggaaagaagttaataatgtggcacatatacaccatggaatactatgcagccataaaaatgatgagtttatgtcctttgtagggacatggatgaaattggaaatcatcattcccagtaaactatcgcaaggacaaaaaaacaaacaccacatgttctcactcataggtgggaattgaacaaggagaacacatggacacaggaaggggaacatcacactccggggactgttgtggggtcgggggaggggggagggataacattaggagatatacctaaagctaaatgatgagttaatgggtacagcacaccaacaaggcacatgtatacatatgtaacaaacctgcacattgtgcccatgtaccctaaaacttaaagtataatgataataaaataaaataaaataaaaagaagaaagaagttaatatccactttaactttggagagaattctctaccgatattgatcatgtagtcagagagatttaagttttcaatttagaaaccatagagaggcaggtggcaaattggaacacagatttcattttttctgcttatcccagcatttgtgagtgagaaacaagcagtgaatttatttccgttagaaacaaaacaatataaaaatggatttggagctatttcccaaaagaattttagtaagacagtgaggttaaatgagctccagcccctttgtgttttttgaactctgttcagtgagcatctacctccagccatctgcggtaggatcccagatgggcaaatgctgtgaattagtctgaggccagctccatttttatatttttcaaaaagctttgttcttataaaataatctccatgattaaggcaagaagaaaacttatactgaagatttgaatctgttattatgacatgaggtaaaagaaacaaattatggccaaccatcactatgcctgaaaatgactggttttcaataggggatggctaaacttcagcatgcagtgagttgcaaaaaaaaaaaaaaaaaaaattatcacagtctctgagcaaacaggtgccttataagtgaaaataagttaacatttgattctctagtcattgatgataaacaggttttattttcttaaattaaaagcaactcttggtctttaaatgttaagagacatcttctcttaatatgttaaggcatacctgtctgaaaatcataagaaatattccaaatatagccattttacttcatagtacatttgtatgtgaatattcatatggtcatgccaagagatttacctcatacagataacattcactcagggtaacagagtacttgtatcccaattcctgctcaaatcttcacggctttagcaattccaccagtgatgtttctagtttgtcaaaaagacaagattttttttggcaaaagggaagagacttccgatttgaagtactgttgactccatgtccaaaatattccttacaccagatttatcaggcaacctgtcttggaagtgagttttctcctttgggagccaccccacaaaagcctatttttctcatcactcaatttcagtatggttctacagagctgagccgccatgtgtgacagtgctttgatagatatcataaggtcacagaatggtgggagaggagtggagagggtgcactaaggtggtgtccccgtgctcctactgtagccaggaagtgtgctggctgctggatggaaaataccaccctggatttcagggcaattgacaagggacaatgcagtggggtctccagaattctatgaatgtcactaagtaggaaaaaagaagaatcattattcaacatccgctttctcatcattgttgctaaaccaatgtcaaagcaggagaaaaaatttgggagagaggaaaattgtaaaacagtattgagaagacaagtggttagtatgtaaggaatgaatatatcagtcaggagttgcctgtctcatccacgaattgtcccctggggtgacagtatgcacatgtgtgttttaggatgtctcttctgaaagcatttcttataactctagcttctgggttaacgttacttttcttttcttgaatttagggacaaaaatatgatgtttacctcccactccattaaagttatgtttaaaaaggttagggaagagtaagcatattaaatactaagggacagaaacttgtaagccatctgttttgactctaccaccttccaggtaacctaatctaataatatcatctaattctgaacatataaaaagaaagaaaacacttcttacaacacagagaatgaatttcaacatgaaacaataagtactagtcagaagtaaaggctatgaggctgtgaaatgcctcagagggtcaccagccaagcaggcacagaatgggttacaaagaggtgttgtctccagtgaaactcaaggatgggcagtctttttcttcaggaagaagataaatagggtgaaggtgattgagacaggacagcaagagcaaatgcttcaagttggaaaatagcctacagtttggaaaacaatatgcagcatgacatgaccagacaaggtagaaactgccctcaggtgatcaggagagtcacaggtaatgcaaactgccacctggaggtgaacctctgtcctgcataggggcaggacccaaggatgccttgtctagtgttaaataaaggttactggtgaactacattcatttctcattgtctccagttttcttgaaattggttgtcctccttgatctgtttcatcatttttctacatttaaacaataatttttaactttggagagagaaaaggagaaaaatattaacctgagatatacaaatcaacccccatgatttgtggtagaaaaccatctttctatgtaataattgaaagcacacaagtcaaacgttctgtcacttattatctaaaactgtgttttccaatggggcgcaccagcgatccagaacacttcaactctagctggtccaaatccaaatgtgatggaaatataaaacacacactggagtttgaagactgagttccagaaaaaaaaaaaaaaagtgcaacagatcattaatttcttacaatgattctatgctgaaattaaaatattttggatatattgaggtagtaaaatatactgttagtagtcatttcccttgcttctttgtacttttttcagtgtgcctagcagatcatcttaaattacctatttggctcacatggtgcttctatcagacggcactgttataagaccctttgtctaccagtgtgcttattcctttctgttatacttgggaactgtcatgtaaattaaaataaaatattcatagaaaccaacaaggcctctttgctggagacacgtgatataaaaaaaaaaagtgtgtcatgaattgccagccttctctctccagactaagtaaacagtaggctacagaactccgtacacagccacataatatgaaaaagcagaattgccctgctttgcaccaatggtacagcagtctgacctctatcattagagccgcatttttaaaaccacagttcaaaaagtcacgtcttcttgcttggtgctatgtcagtagactaagctctcaccacgtggtggtactgatgggcatcctatacttcagtaacagctcatcaatcccatcaataattgcaacctgatttccaccgaaggcagccaagaccaaggaggcaatgatgagaaaagtacaatcagtttccttgacctcacaaaaatatatacacatgagttaatggaaatacatctcctcacttttttgcatctatttatttggacatcatgtcagtaaaatttgcaaaaatatcacaatagactctcataagcccttcacctagattcccctgttaacactgtatcatatttgctttattatatttgcctctgcacatgtgtatagcttctatgtatgtatgtgtataacaattttaaaagctattttgatataagttacagaaatgatatccattatccctatatcttttagcatgcttttccaaaaaacaatgacattctcctatattacagttatcaaaatcaacaaattaatattaatacatttctactatcttatccagacatttgaatttctccagttgtccaaataatgtcctttatagtaagaaaaaatatatctgctgcaagattcaatttgggtcaagtattgcatttgatccccatgtctatttgttgagctttatgatggaagagctctttattatttcttcttttttcatacctttcatgacttcgtgatatctgaagggtagaggccagttttttgtaggatgtccctcagtgtatctgatggttcctcatgataaagttattagttataattttggttataatttttggctgaaatatcaaggacatcttgctgcgtcctctgtgcatcaaatcactgaactctgtcccattgctggtgaagttccccttgacctttgactatttggtcatgggctatttgccagatttctttactatcaagttataagttttcctgttgtaattaataagtatcatataggtaagtactttaagactaccatgaataaatatcctggctgtcatcaaactctgacccataaattagcatctattgatcacttttgcctaaatcgatttttagtataatggttgccaaatcataatctcctaatcaaattattccttcaatattcattagttggcatttgtttactcatttatttatgttttatgttagcatctactcatggattcttatgttattcaatgtgttataatctacctctggcattatctattttgacaatcaaattgccccagatttcttcagcgagcccacttcaagctggctcctagtttcttatgacacaccctcatcattctttaaatattttccttaatttctgaaacaacaagctcttccagtcttatctgagttctccttgcccaattctagattaagtcacttctcaaaaaaatccttcgtttgttttcatggagaattaagtttagaaacaaagtaacatgtatcaagtgtgttcactgctactaagaatacttctaaaccctctcagctgacggagctagcaaatttaaaaagaaatgaatgcgtatatgtaaatatatgtttgtgcacacacagacctacaaaacctcactttttaacacaagtgatatgccagagagtataccatgagaatcaaaatgagtataatatgtagtttctatctactaaacgatatatattttagaaaaggttatctaaaacaatctttaaaatggcattatgattaaattgttgatcattctttttttaattagcaaataaaaattatatatattgatagtgtacaacatgtcactttgatatacgtatacgttgtggaatggctaaatcaagctaattaatatgcaggtatctcacatactttatttatttatttatttattttggtgttgagaacacttgaaatctactctgttagcaattttcaagcacatagtacattgttagtagttatagtcaccatgtcatacaatggatctctttaacttattcctttgtctaactggaatttcttgttctgtggccaacatctccctaacaccttccctgaccttctgggcccctggaaaccaccagtccactctctgctcctaagagtttgtctttttagatttcacacataagtgagatcttgcagttttgtctttctgtgcctggattatttcactgaaggtaatgtcttcaaattgctgatcattctgattccttaataataaattcataattttaccactcaattagctcaatgaaagactccagttatgtactaaattgcagtggaaagacaatttattgtcaattgtgataaaactattataatggagatttattatttattatcatcactttaaaaaatcaagaataatagaaaattcttgataaattgcaatgttttatctcttttgaacgtcttacttatttttcgccatgctagtatggagttggcagtgatttgtgaccatttcacagatgaggaaccaataattcctagaagtcatggaactagatcacaaatcaggttgatgtgtcttcaaagcccttgctttttatcaatattagctttgatcaggggattggctgattttaacaccttgctaagtaaaagatagatttaatattaaaacctagctctgaagttccctaaatgttcacaagcagcagcattaaagagagaataaaataatataaaatcctctccaatcacctcttagagctctagcacatgagagtgagacgaaaattggttgaagaactttttccaaactctacacagcccgaagattctggcatagtctgtagggagttccagaatcttggtgaagaagatatttgtgtcttaactctcttattttctaggagacactttttaaagactagagggaaaagtgggcttttgtgactcagatctgctactaaaataaatacttcatttaagtacaagatctcaggtccattgttcaaaccgcaacaacagaagtaggtaaatttcattttgatctatttccctttattctttgttatagatagcttttaacccaagtattcatatttatgttaatataaattataaagaggaaacaaagctgttttacaagaaattgatgcccggatgcatcaaactaaataatcgatgattgctgtaactgtgggggaaggaatgtgtccaggctttgaagcaatgttccttgaatggtctgtcatctaaggaaggacaaatcaggatcacatccacggaacaaacagggccacctgacaggaggaaaaggctaatcaggaattaagggaggtaatgactcgtaacaagtagggccgccttagtcccgtggcctgacctgctgaggaaacgagcccctgctcaggctggattaacacctttacatgcatctgtcttcatcccctcaaacagtgagttaattgggatggaaaatgaaagcttgagaaaaataaattgcacctacctggataagagacagatcctcaagctgtaacctgaagaggtagtttctgcaaaatacaaaaacagagcagttttatttttaatagatcacagaaagttaagagtttataaaaatttcaagaacaaagaaaataataattttgacttcaaaagcatcttctttctaagaatatgttcagcactactttccttggatcttagagtacaaagaggaattcaagaggtcaacaaatacacattagagattggtgagaaagctaacgaataagtggggtgtgtctgtacatacttacggtaagtgtaagtcattaactggatctcttgatctatatggaataaataaaaggacatgggcattccattctgaaactcttttacttaagatgatgtacaactattcctcataggtcttcctttataattatcacctaaattcaccatgttttataattaagattttgaattcaagcaatgctctgaggttcacagtactctaccttgtaagatggattcagtacgtaataaacgtttagaaatatgaacttgggcccggcatggtggttcacacctgtaatcccagcactttgggaggctgaggcaggaggatattttgatcctgagaggcagaggttgccaggctcctgggaaccatggcaaaatctgtctctacaaaaaatacaaaagttatccaggcatattggcttatgcctatagtcccagctactcaggaggctgaggcaggaggatgctttggtcctgggaggtggaggttgcagtaagctgtgatcacaccactgcagttcagccagggtgacagggcgagaccctgtctcaaaaataaataaataaataataaatacataaatataacttgcattatataggatttggtttaaaaagaaaagaaaagaaacatgaacttggtggtctgcccaaaggaaactgatgacatcaagggcttcaaagagtcaagtttcactgcccaagtataaaataggaaattagagaaaagtaaaatatcaatttcaacaaagaaggggaagaatagtgaaacatgcagtggagatcagtagaggacacagaaaaaagatagattagttacactgggctttggactctagtgttgtaggttttagaaacaactcattaacctacctcagtattctttgcttcagcctctaactgaaatcctggcatcatgtaaatgggaagatggggcggggatgtgcaccagcagcaccccaaagaggaagggaggagaaagccagcctaagtgcaaataataatgtcaagaacatgctggcacataatggtaagcaaactctaagatgcaaatgagcacgaggtgggatctccaagaagccaaggatgctgttataatgggctggtccaaggtcacttcttattggttttacaacacctataagacataaatgttgactattttcactatcgtgggcggggggtgggggtaggtatataaactggacatatatcccagtagaagtgacaagtgacagccaaagaggcccaagggcatagccttgagatgaccaagaaacatccctatgagttatggacagagttagggaggacaaagcccccatggaagccggcactcagaagcacatgtacacacacagctgaaggatgaaagaggactaggctcacattcaggtagtctcatgagtccaggcattgcctcctgggcattcaggtttcacacagtttgcctcctcacatgggggtaccacctctctaaaccgagtgaaaacagcctcacccaaaccacagcaatagtctccttaccacactctttccacctttcaaatctcacctctgatataccccaagagaagctcccagaagcactgcttggcacatgccacctccatcacaaagccatttcaggaaacattcccctgtcctttattataatgctacagccctctatgtagaaccaggttaaggatacctctgaggggagggaatattacaggaaagtcttttgatttagtcagtgccatgagaagactaggactccaacagaaatgtcatctgcaggccaggcacattgccccgtaatcccagcactgtgggaggccaaggtgggccaatcacttgagtcctggagttctagacaggcctaggcaacatagggagaccctatctctacaaaaaaagaaaaaatacaaaaattagtcaggtggcatggtgcatgcttggagtcccagctactcaggaggctgaagtgggaggatccattgagcctgggaggtcaaggctccagtgagccacgatcctgtcactgcactccagcctgggtgacagagagagatcctgtctcaacaacaacaaaaagtccttttcagaggaacaaatgtgaacttggtgcacatacagaagagtatgttgaagcagccaaggtaggtggcactggagggtgactcgcatttcaacattagccaagctttcacccagtgtgaccttgaaaccagcacacctcctctaagggaagcaagaaatctacacacacacacagacaagtctttcagaagcggggcttaccagtgtgatatagtttggctgtgtccccacccaaatctcatcttgaattttaatccccataatccccatgtgtccagggaggggcctagtaggaggtgattggatcatgggggcgggttacttcatgttgttctcatgatactgagtgagtctcatgagatctgatggttttataagcatctggcatttcccctgcttgcatttctctctcctgccaccatgtgagaaggcccaagcttgcttccccttcaccttccaccatgattacaagttttctgagccctcccagccatgtataactgtgaatcaattaaacttatttcctttataaattacccagtctcagctatttctttatagtagtgtgagaacaaactagtacatagcggcaccagggaaattactagccattgtacacccgttgcctctatgagcagctcagctccccaccctcacatatttcccactgtctttctggtttcaggaggctgcccctctgctatgggagtcagcattacctagcaattaagaatattcatgcaaaaaccagagttctgcctctatacaatctcaggaagaaagcatttctttctatgccttagtcttttcatctgtaaaatggagctaataatcaaacccattccctagggttgttgtgaggtttaaatctaagaaaaacacttggaatgaagtctgacccattgtaagcatcaattaatggtgccaacttctatgttaattttgtcattggtcctggaatccagtcaccctactccttttcaacccactggcaattttaagaaggacttcttcagtaaatatttccaataaaagaaactcattcatttagtaaatgaattacctaagagctttggtgatatctcatggttcattctttcttgcttactcacacacatacacgtgcacatgtatgttcacactatggtatctgtctccagaaactttcttgaaaagaagctttcatacacaaaggaagagctggaagtgcatcagggccttgagaaaagacgatagcacagtctgcagtgctctgtagagctctgtgcagatcaagcagagagctctctgtctacttggagaggggagtggaggagacacagagatcgccatccacaacacctgcttccggttttcaggtgttttccatagaagaagataatggcttataataaaaaatacgccactttctcagtccacacctccataagcaaatataactcttctgatcattatttttctgcttctcaagttccaatgggctgtaaaggtacccctcctctccagaaacattgctagtggagtttaaccatctacctcttctccttccaaatacctgagagctatggtgcccttccaatcatctcatcagtaataacaaatcaatatggcagaggtattcaataggggaaaggaaggggcaaagaggagggaggggcatgcttactaggaaaaatagcacagttactatgaaataccatcaccagcaccagcaccatcaccatcaccacatccaataccccaggaaggaaagcaccagaggatttgaacttttctttttgtagtattttctgggttgcaagataaaaattggtgattattttaccccattccatatttttaatctaataatatagagtctaagaaatcaagaactaagagtcactaaagagtatatacccttcaatttatagatgagaaaacttctataaattaacagctgcagtgagatttgtccaatactgtaaggtttcagagaaagtcctgggattagaaacaagccccccgtgtcttggtgtcctttgtcccattatgcctcaaggccccacctattagttattcaatgtcaccttcctaatttcacctgcaccaaacatgcacacacacagaaacaaacacagtaacagctcttatgctactaccatttcataacttcactggtcatttacagcaacatttacaaatcattttaagaaaattcaagtcttagttctgctaataacaaacttttgatcctaggccatcaattttcacctctgggactgtgatctggctgtgatgtatgtctccccttgaggagaacagtttgagcctacgggtctggctgtttaaatggcacctcttttctctctttttattttgcctgaacaactccctgcccatacctaattctaagaatatccctatttcttaacttataaaatgaaagagataaactatacaattatctcaatgtatttaaataatacaaattcccaaaagactgtgaccatgtttagatatacacattgcctaactaagttctacgaataaatggccattcaacaaaagtatttttattatggcaaatttaaatcatttcctgagaagtgtttttcatgtgttatttttcacaactgagtaacttatttcaaaataatcttaaaagaaatctcaacatataaaatagatacaataattctttaatagtataaattgatgtaataagtacttatgtatttgttaataaaatcagttgatgaagctttcttaaaaaaattaaaactccacttatcagaactatttatcatcttacacagatcaacatctatttaatgtgtatattcatgccagttgattggttatatttttgttgattttttatttgtttgatttttaaggcacagagttggtaggtgcttttaaatgtttctttttttccttttttttttttttttttttctgagatggagtcttgcttcttcgcccaggctggagtgcaatggcatgatctcgactcactgcaacctccacttcctgggttcatgcaattctcctgcctcagcctccccagtagccaggattacactgacatgccaccacgcctgactaatttttatatttctggtagagacagggtttcaccatgttagccaggctggtcttgaactcctgacctcaagtgatcctcccaaagtgctgggattacaggtgtgagccaccacgcctggcctaaatattagtttaataaatgactatggtccatggaaaacccaagtagtcaaatacctcactacacaaacagtttagtattcaccttattacaattttcagctattttaaacaatattttattttattttttttttttgagatggagtctcgctcttccgcccaggccagagcgcagtggtgctatcttggctcactgcaagctctgcctcctgggttcacgccattctcctgcctcagcctcccgagtagctgggactacaggcgcccgccaccacacctggctaattttttgtatttttagtagagacggggtttcaccgtgttagccaggatggtctctatctcctgacctcatgatccacccacatcagcctcccaaagtgctgggattacaggcgtgagccaccgtgcctggcctaaacaatattttaaaaggtgaaccataagtaaaacatttgtggaattccctaatcacatcccaagaacctaagaatctgataaaacacagtgtggattctgctattctcaaatctctttccttgaactatttggccccacatacaactccaaatgcatttttgctgtaggaaaaattccaagccagctggcaacatgagggacttgaaatctctcaagacagcttgatccatcacagtttaggtcaatgacctacaaagttaaaggttacaaaaagagagaaaaccttctaaaggggataaaaaattgatattcccaggtgttgggccactcacaaactaaagtaagatctacagaaccctgcaagtggctgtcctccaaggtattacagaagaggcaaccactttatcttgcaattgtgtgagcacagaggagggaaaacaatatgcgtgaggttcatgagaaaggccaccagcctttccaacatgaaggaataatgcttctggcccctggccaactggaaatgctaaccaaatgttgcaagtagggtcagtctccctaacagggcaatgctttgagcaacccaaagcatttaagtgatctcattaatcttcataacacccctagatgtaaataggtagtaataaggaatattgccattcttcagggaaaaaggcagtggtgcaagaggttaagagattagattctttgaatgcattagttgtatagcttggaggaatgattctatacttctatttttctcctgtcattaccaaaatgaaaagcaagagtttgccaaagtgtaacagttcagtgttatggctatagcaaataaaaacatgagttttttctgcctgtggtatggatctacttttttttttttttctcaaatgccatggaataaaatttgacattgcacattcacgtgcaataaaccagattccttttaggagtaataacatatgaggagtacacagatccaatgggctgaataattcaaatcacaaagctattaagtttggcagatgcaaaatcacaatattgaagcccattcttcgtttccccactagacacctgagtgcgttttctacgtcttcaccaaagtttcttgcttactgactctaggattgaataactcattcctgggtcccatcacttcccccagtggcctattagaaacaaatcactaagcataacaatatattctcggagggagcagtggggaccttaatagatgaagttcatttgtatcttcatgtaaagtagtaaaatgcagccggcattaaagaaaaggttgagccatcatgagcatattaactaaatgactcatttcatctagagacactataaaacttaactttgacctccataaattatgaaagacacaggtgttttaaaaggacattctcttagaataactcaattggcctctgatgaatatgactataaaatcaaagaaaaaattacaagttcctattgaacgtatgagttagaggtttgcttacaactgagaaaagaagaattaaggaaggtagatttgtattttgtactagagcaaatgaaggcagaagccgataaaatgtataaagacattttaacaatgttgacagaaacgtttgttgctgattaataaaagtttagaccaaggctgatcacgaaacaatccaaagacaaaacagacactgcccatgagccagttggggaaggctgagagctgaccagtctctcctgtccctgcaccagcttcctgcacacaatactttcctcactgcaagtttccttccatcctcactgctgtcaacatctaactggcacagaacttttcaagtatagtgacatcctacatgatacgcacattttcaattgcactggtagacttttgaagataacaagttatgtttgagatggagtctcgctctgttgcccaggctggatgtgcagtggcagcatctcggctcactgcaacctccatcgcaggcattcagcaattcttgtgcctcagcctccagggtagctgagattacaggtgcgcgccaccatgcccagctaattttttgtgtgtttttagtagagatggggtttcgctgtgttggccaggctggtcttgaactcctgacctcaggtgatccccctgcctgggcctcccaaagtgctgggattacaggcatgagggaggccgaagcagacagatcacctgaggtcagtagttcgagactagcctggccaacatggcgggaacctacccctactaaatatacaaaaaaattagctgggcgtagtggtgcacaactgtaatcctatctacctgggaggctgaggcacgagaatccctgaatgtgcaaggtggaggttgcactgagcagagatcctgccactgcactccagcctgggctacagagcgagtctcaataaataaataaaataaggaaaaatagtaactatatcctttaaaacataaagtgttgtaaaattagtttgattatctaagtgtaaatatttaatatcgtgatcatatcagtaaatttaaatataatgatttaatttaatcatgtaaccaactcatataattcaccaattcaccagcatgtctataattgtgatttccaagacttttcattatgctggtcgactctaagtaaattctaggagactttttattttgtggttataactatcctaaaaaatgtctgcttcatgtatttttttcatgggtttctcagaagataattaaatttcaaaattacaaagcctttccaaatagtatcacattatatttaaatagttagatcacatttaaatcacagtttttaattcttttgtgagtttttttctaaaatattttaaaatatggtgacaaatttataatatggtcatgtgattagctatctcctcagtcagaattttctctaccctcctcaaaaatagtaaatatgtattcttcgggctatgcaaatttcaagataactgtaatttaatttttgttgctgttaatactgttacgtgtgtctggtacccattctcccagaatcatattaacttctttcattccctatcccagaaagagcattttgagctccttaaaagtcttggttattagaaataaatttcaaagaacacactaaaactgagatcaaaccattttaatagcattcttatatatttaaataccaagattaaaaggtgcaaaaatagatggatagtctcttattatttagcaagtagaatgaaataacaaagatacattttaatggcatgcagtaactaaacaatgccgccagcaaatcttagagatataaaatcaggaaaatattttcccacaaatatatttagggtaaaagttattaatcaatattgttaataattacactaatagtttacattttattatgctttaattattacttgcaaatctctaagtgctgtgaggattacagatgatgatttattgctctaaatttaactcgcgacttttgcctttgtgggtcctctgggtatctgatttgttcctttctgtttttcagttaacagagataatttttcatttgaaaaaaaatgccaactgaatatttctatggttcctttaacctgtgatttcctaggactattcatgctttaaattatctccatatacaattaattttctaggttatcttcagtattcatacaaatctgagatcttttttctcatgtatcttctaataatcaaagaattacagctcatcctcccatatgctctatcccagtcacactcccaaaactcactgaatggtttgatgcttcccaccagccaacccactctgttggccatcaattgctgtcaaaatcagaactgaaacgtgtctcaaatctggcttctcatctccattgccatcatcactgcctaagtctaagcaccctctactctcacctgatccacaacccgcaactgccatgcctcgctccaaattctgcaagttctagtgcctagtgcatcctgcacacaatatggtggacgtatcttcctaatgcaaatatgattatgtgaacatataaatgtagaaatctcctgggctcctcaatgcctttagcagaggttctcaaatttaccaagccagcagagcaatgggagcttgattaaatcaaagattctggccgggcacagtggctcatgcctgtaatcctagcactttgagaggccaaggtgggtggatcacttgaggtcaggagttcgagaccagcctggccaacatagtaaaaccctgtctccactaaaaatacaattagccggatatggtggtgggtgcctgcaatctcagctactcgggaggctgaggcaggagaattgcttgaaccaaggaatcagaggttgcagtgagccgagatcataccattgcaccactgcactccagcctgggcaacaagagtgatgctctctctcacaaaaaagattctggcattacttccggaaagtggaattcagaggacttgaggacaggcctggacatctacactcttgaaaggcctgtcaggtgaacctaagactggcccagttggagtcactggtctagaggactaagtctaaacttctttataatctggccccagctaatgctcagagcttcacctataattacttccccctctctgtcaccaacaggtgccacggagccaagcacttttcagcctcatcagaatctctgacttttcccatgtgactctctgtcttccctgccagattcctcaagcatctctcaggccccgttggaggaacaccttctctatgcagcctcttcagatcgatgcaccatcatatccctttactcttggtgttttcaggaccctttactcaggcttcccttggagaatctaattgcttgtgcccgtctcacccactaggccaagatcatcatactttttgttttggggccagagagcagatagtttgcttttgtggtctatgtgccaactactcgtctctgcagttttagctcaaaagcagccacagaagatgtgtgaatgagtgggtgtggctgtgtgccaataaaagcatatttacaaaaacaggaggcaactctggggccccagcttgccaacccttgcgctggactagaaagtcctcatcaggtagagaagatgcttcatctttgtttctctaatgcctaagaagcttcctggcataaagtaggttcaataaatatttgagtaacacagagtcttgaaagaagaactacatgaactaatacatttggatgaaccccatgtggacctggtaggagaaaagctctcaatactcagtctgtagcacatgtacatgcaaataagttattcaattattatcacagccctttgttggtttgctcatgggatctgggaaataggaagcctttgtacatttatttatttatttacggctgtcccttggtatccccagagcattggctccaagaccacctcgagtgccaaaatccatggatgctccagtccctgatatcaaatggattggtatttgcctataacctatgcacatcttcccatatactttaaatcatctctagattacttatatcgagcacattataaatgtaaatagtcgttatgccatattgtttttattggtatcatttttattgttgtattgtttgtttttaatttttccaaatattttaggcttgtggttaaatctgcagatgcagaacccagggaggaccaactgtatgtacttacttgcttataactaaatagataactgttgtactaggctgatattctcccaactcaagcagggaaaaaaaaaatacagatgggaggccgaggtgggcggatcgccaggtcaggagattgagaccatcctggctaacatggtgaaaccccgcctctactaaaaatacaaaaaattagccgggcgtggtagcgggcgcctgtagtcccagctactcgggaggctgaggcagaagaatggcgtgaacccgggaggcggagcttgcagtgagctgagatcacaccactgcactccagcctgggcgacagagcgagactctgtctcaaaaaaaaaaaaaaaagtacagattagttttttttgtttttgtttttgtttttgttttgttttgtttttttacaatagcagaaggaacagaatggttagaaatctttcccaggcatgtcagttggccaccagtttgttaaaagcacacaccctgagccagctaaatcagcagagctgggaggggcatcttaattttgaacaaatgtcctagctaatacttaagaacattaatgtttggcaaatgttggacaaaaggtaacaaagccagcagacaacaaggagactttttaacatatattgggtaaattaatcaaataagcgaattagaagaaaggggagaacaagtagaagaaagagagagataagcccagagaatcataaaggacatacctgtgcataggggccagccctgagaaggaaagggacagagaaggggaaacctttaaaccctaaagtggaggttcataaagatttgattggaagaggacaaaaaagactgcagtgaaaagcactgttccttttccatcaccagctgcttgtcttaagtcataattaatgtaaacacaacatgaaaatcagcattacctgggatctcttcccacaatggggttctactcctttttgcattcactgctaatctctgatttcataccgctcagcatgtattccctttaattgtgtcaacttgactaaaatatactctttggaaaagacgaataagtgtggctactggaagcagaatcgctgatctgataaacatcttcagttttcctgttaattatatattgcctccaaaagagtaattccaaggtaaaattttcaagtaaaaataagaattataatcaccgaaaaataatgatattggccagttgtttaaaataaattttatgtgaatttaaaattaatcccccttgtttagaaccagtgtgataaagtcattttgtaaagaagaaactcattaaatagaagcctaccgtttattttatgcgtctcataagaatatatgctatgttaaaataattgggaggccattagattgaggaggcttcactgtcttgggttcctatgtaaacaaaccaaaattcaactcaatgtaaatagtaaaaggaaacttaagcttaaccaatcagaaacaaaaccctaactaaagtctaacttcagacttaaccaattagaaaccaccaactaacctctaactagggagtttccactttaaccaactagaggcattttctttgtcttgtttctgggaagaatattataaaagtttcctcccttgccacccccacccacaagtggagagctgctggaagtctggtgatgcttgattcctaaatctctaaatgttcaaataaacttgttaaaattttaatgcacctaagtttatcgtttaagggttttgaatacttacagcaaattcagccagagcataaaaacagcaagttaatctttccttttttatctgtagttttgtaaattcaaaccattagccaaacaaatggttcaaaataataaacgaaaaggatcagaaatccatactatttgttgcacatacatttatacagacatatcttctgatatctagaaatactgtaatggtaagtcaaggggtttagtgcaaggtattcaggcagctatgggctgatactcacattgggtcaggtgtgcaaggcgtgcagttatgggctggtactcacatcgggtcagaagtacaaggtgtgtagttatagactggtactcacactgggtcaggtgtgcaaagtgtgcagtatggactggtgcttacatcatgtcagatgtgcaaggcatgcagctctgggctggtactcacattgcgtcaggtgtgtgaggtatgcagctatgggctggtacattgggtcaggtgtgcaaggtgtgcaactatgggctgctactcacattgggtcaggtgtgcaacgtgtgcagttgtgggctggtactcacatggggtcagatgtgcaatgcatgcagctatgggttggtactcacattaggtcaggtatgtgaggcttgcagctttaggctagtactcacattgggtcaggtgtgtgaggcatgcagctataggctggtactcacattgggccaggtgtacaaggcatgcagctatgggctggcactcacattgggtcaggtgtgcaaggcatgcagctatgggctgctactcacattgggtcaggtgtgcaacgtgtgaagttgtgggctgctactcacattgggtcaggtgtgcaatgtgtgcagctatgggctggtactcacattacatcaggtatgtgaggcatgcagctatgggctgctactcacattgggccaggtgtgcaagaagactcatgcatctctagtgccttttgttcccttggtgacttaatgttctcattttgtgatgttattttgtatagaattaaaatcaaacatttccaaggacataaatcattatatctgctatgaattatgatcattacctgatccaagtattgggtctgtgggcctcaatcccaccaccttacccatggcagatgtttaggccatgtggactcacaggtatttgtttgagagcttacagacgaactttcttactaaaataccacagtttgtaagactgtaccctttgatttatgtttatattacactcaagctttttgggaaaagtaagagaatcagaattgagtaattggatgaaaataacttaaagaccaagaaacacatttaaaaacctgaagaaaattcacattttagaaactgagatagatgttaaaaaatgttttcatttagaaaaatcacattttgaagaaaagcacctaaatagccagaaagagtgactccacatcttccccacagttcagtggcaaagactcatgctacagatgctttgataataaactctttttcattagcactgtaggtctttatgcattataaaaatatggccaatttgtaaatgtccaacagcattcaaacactgccttatgtgtcaaccaagttagttggcatttggaataatacttggattcagcacagaatacatatcagagtaattcgggatggaatcacttgccacccttagaatgaacctgaaacactaaagacgaactaattcatttgggaaataaaaatgtaatcaccctcccttgtatctgttgcaacaattcaatctgcagtgaaacttacacttgtatcaagtgtgtggagtgttatcactgccattccttttataatcttctatacaaaaaccagtcataatatattctttcattttgaattttttataccaagaaactgatcttagtaggatttgtgacaaagaagtatgcaatcattcaacaaatattatcccaagagtaggaacaaatagaaatcaaataatgcaaggaaataactgaaatgcttcactgtgattatctctgaaattgtttttttctttatgctttactgtatattctacattttgtaaatgaagatacctaagtttcattactgaaaacacaaatattattaacttttaaagagactgggggaaaacaagatatgactgttgatgcatttaacataatacgaaagttcatgtgcatcctggaaatgaaaatgtatgacttcttccagaaattccctgaattcagatccaagtaccttccgattctccataaccacaaatggctgaaagagaggcttttcttttgcagcctaacgaacttcctttatcaaagagtacaaagaatctttaactgtttcaatttcaggaacatacagtatcactagtataaagtgaaaccatccaataaatggttccacaatgcctagtgctatgagaaaaaaaaatcgactattattctattttttcacaactcatatttttaaaccattactgatttctgaaatatacacctgttatctaaacttactcttgctaaatcaagctttgccaaacaggaatctgagggctgggttatttttaaagttttatatcttactcatatgccctctcaaactttctgagcctaatcccatgaaatttcccaggtgaaattcctattctcttctttaggtagcgtctgcctgaaaggcatatgcacacgtatgcgaaacccatgaagaccctcagagcttccctagggctgcgcgctcaccagcctgcctgttaatgtgacagtaacttctcacgggttattttatttcatcttcgcaacagctgaaaggggtagaaattgttgcatcatctttacaggtgataaaatcaggctctgaaactggcttagagtcacttaggtaggggccagcctctttttttttctgttattatttatcaagtgtctataatgtaccacacactgctctagaataaaaaactacagcccatgctcccggggtcaccaaacctttggaacatacttatgataaacatataaaaggttgttatttggaattcaaatttaactgggcatcatggatttttatttgctaagtctggcaatcctatgtattcatgtccaccatgccatacagcatgctaggttgactcagcggcccatccgatccttcccagcagaccatgttgatatgcaatggatggagacctccaggaatgaggtctgggatgaggactccagggatattgaattgcagattccaggggccctgggatggaagccacaagacacattgggatggagactctagggacgctgggatggacactctagagacattgggatggagacgacagggatgctggggtggaagctccagggaaactagaagacacagagatagagacttccaggaatgctgagatggaaaccattggagatattggacagagacctctagggatactgagagagagagagacaccccactgacactggaatagagaactccagggactctgggatgaagacctcctgggacaggtaccccttgaaaacaattcccagctgccatccacagccagaacaggagcataagacatctcttcaaaataccctaatttgctctgtggcttctcacatcccttaggaaaatcttgagtcactgaccaaaagccaaccacttgcagagaatgaagcgctggtctgttcacacagcacccaggacctccagagacaacaagagaatctcatgagtcaaagtcatagaaaagcctttccaaagttctttagagatgaatgagggatgcaagactcaaaacactaattggggtcacatttgtacctgccccaccccggtaaggggtctgttcccttgactcagagtgaaagctcattttccctcagggtgagctttggtgtatacagcctgccactggctcatgcccttgccagatgtaggtgtctgagataaattgttataatcccaacccccttttccctaagtgttcacctggatgcagaggggaacatagacaaattcaactctggaaataaatgtgttgaatcaacaggtatctttgagcttctataagcaggaaaaatctgtgctatatgctggagaaataaagaaaagacaggcacttcccttgccttctggtaagtcaccatctgataagggtgacttgtcaagaaataatgcaatattgtacattaagtgcagttaaaaaaaaaaagtagatgtccagtatgttactagggccacacaggacagagaatgtggtggttcaggactgctggtggacccttgagccaggtccttactacaagtgggagtttaccaagcagataatttggagtgggggttggtggcagccagtattccagaaaatgagaaagaggtcagaagggaaaaagcccagaggcaagaaagagcatattccataagtgtaggcagaataaataattccacatgcctggaccatgtgagaatgaaaacaggcaagtctggaagggaagtgggaatgcagggcagaagggctggcgtaccacaccagggagacagcttatatccaatgggagctactgaaggtgggcatttttaaaagatgatgttggctgtggtatgcagaaggaggagaacatctggaggccaggagactgatttaacaccactgcaaaacacaggccgaactccaagtgatgaaatttgttggaagtgagcatcagaaatcccccagtattgctactggactaaggtaaggaagagaacaccaagtagccttgtccaatccatactcaccgcctcctcacaaacgtcaaaagaggtgaaggtaacttgctaggtgcaataaactatgccaacttcttcctactcatgtaaaattacaaccattcatcacttcaagtgttgagtggatgtacaaggacacctcaagatccaagagcaaaagcaacgatcctagaaactgttcaatgtttatctagagtgcccagactataagctagatttagctgcactcgtgtttatagagagactgcaaaacctctgtagctatggcaggcatgctttatactctggtacatttggacaaaaaatataatgaactctccactgcccaatgtgccatccttagatgccagaggaacccaattctacaaatggaccctttcttaaactttaatgtcaattttcctaaaagatggatatataatcccaaaataggtaatttaaatgcaaggattatgcaggttttctaaggaagtgatagtgaaaacaggggaaagaactcaaatttgtttggattgtgttccagtggcctcattgtcaaactgggatgcagatgttgacctagatacgggaacactcacacccttaagagataaagataaaaataacttcgttgaatctcaatttactggtatatggcctaatcaaggtaacaaagaaaggtggtggtgggccttggggtacacatcaagatctctggatctctagaatcctactgaagaatatagtgggaagtcaggaacatgttttcaggagtcaaactgactgggtttggaacccaggtccatcttttcttaggcatatgccccggacaacttatttatctacttccttcctcagtttccacatctctaaaacagcaatgttgatagtacctacctcttaggtttgaatggaggaacaaatgagttaattcatgttagaacagttactggcacagggtgagggcccgatcaatgcttactctaacgggcagccatcaacatcttattagcagtagtatattttatgacactcatactgtatttcattcttataagaaataatattattcagcattcttcagttttgtcagtgaaggtcacatgtaactgcacagatgtaaaatgaagtccaaaaatatctgtggtggcaaaatacaatatctctcaccttgctcctacaacaagttctttctgtcctgggtcaaatgttaactgcgagaaatccacagcattcttcgctctgaactcccgtaaccaggggccaatttctaaatagaaaaaataaataaataaaaagataaaaatgaattatttttcctctggggaccacagatagtgcacatcaggtagcagacgttacatttcagagaggattcggaggtccctctatgccatctttcagaggccactggaggtttccctcaggatgccccataagccatactaagaacttgtaaagcacagagggcagccacccaataaagagcaagcgaggcatcaatgcttggttgtgatttacaagccagatgtgcattttccttttggctttgggctgggcagaaaataacacagcattcacatgattcatcagaggaatactgaatgcaaacaagaccatttcctgtgcaacttgactcaaaagagctgcagatttttaaatattacaaaagcctccttaggagcaaggaccaagcacacaagcatcatttgccttctttcaaattagatgttccatttccctgtcctttgggtttctattttggccccatgattagacttgttaaacacattccgacctttctagatgagaaatccacagttacttctaggcttcatttgcatttttttttctaagggaaatcagaaaatagccactctatagagacaggcttttacaagcacggttaactcctattagacagcctccagcccagagtccgataattataaaatgacagtatttgaggagagataggatgctgcttcaatgagccatttttgcaactttcattagctcatttttaacactaaaaaatattcagtgagttgcccaccaaacgtgggataccttatcattatcattgacaattaaccataacatctgattgtcgttttttcttggatttagtattttgaataacaccaccctgactaaccaggcacataacaactgtcaaatcaatgaagatgttggtttgaggaaaaagtgtgtgatacaggaaagaatctcctccaacaaacgctgatgctaaacacatcagtgttatgtttttaatgggggcatatggaaatatgcccccattccgtctcatatcctaaagaaatcgctttgttgatgtgaatgagagggactattttttcaggaatggttctgtataataaacatgtcttttctctactaacagttacgagggggaagtgatatcaagtaaaatttatcttctgcttaaaggaaaccaggggtgagtcatatagagagggacttgtaatgtatatgatagcttgatttttttaaggattttcatataaatttctacattttataggcaaatcaattaaaatacgtagaacaaggtatgtacaaggcaatggaactatgaaaagttattaataatccttccaggactttataattcagttaaagaaacagcactagtatctttaaacagggtgtctatcaatgcaagtgtttataggggcttgtggggttacaggaattattcttatatgaaaagaagagatgattgagagctgcagtaaaacaagaggaaagatttgaccagagagtgacaggaaagatgtcctagaggggcaaagcaagacagcaacatgggaggccatggtgccccctgtggccataactggtatcactcatcttcactccatcaatgcctccattcctgggcaaaagagaacccaatggctcttgcgtctgcattgctccctgcagtgcatgcagcatacaaaacagcacattgaatgcgataggaaataataaatatgtgaaatgaagtaagaacaagtaagtgagttcaagagagaaataatcaaaaagaaaggaaataagaaaaagagaaaggagaaaagaaaaagtaatagcaacttaagaaactactaggaaaggaaactgaaaggtgtatttaaatacaaactgtagaaaaattcactttcaggttaaaaggtttggacttgatttcatatgtgacagcaaagctttgaaacgttttcaggaaaactcttgacccatttgagcagatgtctttggaatatcaatgagcccttgatagaaagaatggtctggaaagagtagagaatggaaggaaaagtagtatatttttaaaaacctaaaaacctacaatttaggtattggccttgaaaatgaataaagaagatgtgggatcactgattagagatgaagtcaaggtaaacaacttaaaaagaacaaaacagttaccaaattaaatgaagaagaaaacagtgatgactgagacaggcatcagagtttgaggtggctttagagaaagatagtaaattcaggtgcaagaatgggaatgtttcaggtgaaaaatttccaatggtaggttggcccacagccattgttaaacatcgctaagacctagaaatgtccataaagatgttctagttcaggaggttcatcattcagatgggaaacacatgaccagggagcactgccaggaccaggctccagagtgaatatcaggggctctgttcaccacaactcacagcccccagagctgggctcacatccaatcttcaaaccacatgagggaagaacagagggccaagggctgaccttcctgctaggggagtgaagagatgagcctctaagaggaaaaaagactacgaaagatagaagaaaatcaggttactcttttcccatgcattcatctttctttttatttagaagacttggaagaaagtggccaacaggaaccaggctaaagagacatacatcaggttttggtccctatactgaacaacgggaaggcagttttgctacttcctaaaataccctgaagtaataaaaggagtcatgtacagaggaaaaaatgagttaacagcatgtagttctgtcaatattgttcaagtttccttatttgaaattctaatgaactttcccaataaaactgtgtatttttatggttaacatagatcaaagttgagtaatctgcatattcccttctctttcctccagaaggttggccatctcaactttgcatattacattggcttctatctcactgataccaagagagccttgcaagaaagtctctgcaccaactcacctcttgaactaaaaagaagcctgcaccaatacctatcctcccaactttcccaacagatcagagaaaaggcactcaatcctcttttcaaagaccagttgctctcatctcttctttcccctttaatcgcttctcaattacctaggctttcctctaaaatctccaatgttacctagtccctttccctctgcctatatgtacatcctctcctatttcaaaaagcattacatatttttattacactcccttgttattatagcttcaaaaaccccaataaaatgcataataaacttccaagtacaatatagcaatatatcaaaaaaaaaatcacacacatacaaacacacacacacacatacacacacacacacacacacatacactatatttcatagggaatagggcttagcccagaaacgcaaggatggctcagcaagcttagtaacagaaaacctattactataattcatcatcacaataacagatttcagtagtagcaggaaaacgtcatcaatactgctttctaaggaatcagaaaatgaacagttttggaaatagaagatctaaaagagttcagggcaattggtcacaaactagatgccagaggaagttcggggagagtgagggagcaggagggggtccacagcaagtggtgaattgaggggatacaattttcaataacattaagatgctcattgcccccagtgagtttacctttttcctcctatccctattttctgatattgctgaaataaccatatgatgaaatggagcttaaatatggcagccaatatgactatatatatataatatatataatatatattatatatatataaaattggaagttaagttataacataaaatttgtaaattccaactgaacacttgatagataattcataatatttgaggttaactatcctagataatccaatttttacacatatatttacgtgattgttgaaatatggtctccagcaatgattttttattgcaaaattacattcattgattcttagttgccttctcttacagctacataagctcgcatgtgattggtgtataaaatattttatcaaaagtataattccattttttttaataatccagtcttacaacttcaagaaacgatttattttatgaacaagtcagtattaataatttggtccaaaatacttgacaaatataactagagataagctaaatagattcaagttaatgtcccttccaaaaaagaaagaaaaaaaaatcaaagaaaaaagaaatgcaaagaaaaagaaagggaaagaggggtaaaagctactcttttaaaaaaagcagacactctaaatatagccaaggtaatgatgtttgtaaaccaaaacaacaacagcaacaaacaaacaataaagggcagctcttgtggaagacatgacagtcattccaaaatctgactgagagccactccacatgctaacacctgcagcgccaactgtccagaaaccaatctgatttgttagcaaacactgaccagggaaacctcccaggcacactaagggctggctccggatacctgtttcattcctcacaccttcaaacttcagttaattaaggggctgagaaagcaggatttcaaaagctatatgggtgacttgaaacccacattggaaactaagattcaagccaaactaggtggggccaggggacggtgggtaaagattgttgaaaagcacggagagcaacttacataacacacataagtacagtatgtagaaatacaagtgcatatcacagcctacttctatttatcatgtagttatgtaaccgatttagtctgcatcatgacaaaataacgctaacaatatgattatcagcaagacagctcaaaaatagctaatgtttaaatagtaggttctatcttatccactttataactattaattcctgtatttctcacacctgccttatcataggtgaagaaactgaggcattgtaagagtgagtgttgccaagatcaatagctggtaagatacaaacccaaccagcatagtttttgtggttctagccactatgctatattattaaacttcagcaaatataaaatttagcttcctatacagcacatttggaaaattacaggaagaaagaaaaatcgacagcctctccactttgaaagttactctattcccattgatagactgttaagcaaaatcactacgcactcagttttcaactatggactagagaaaaatgaaatacaacagaaagctgggtctctcaaaaccagctactactttaacctgtgaataaaatattgattgtttttgcccatgttaataagggtgatgatctacacaaaaaccattcatcattttttattacccaagtgtctttatgtaagtatggaggaagaaaatgacaaccatgtactgatctgctttattggagtaaagaacattctgaaatcagaacgtaggaatgatacaagcactgtggaatgcttgagtttctaagcagtctaaaccactcaactccaatacaggagttggggggcagggacaaggtactgtcctgaaaatgaaagagctgtgtcttcacctcctcaagatgggaaccttctgtgagcagcacaggaaaagaagtacagggcatattctctgtggagaaattctggaagttcttttttctgacctcttcctgaagttgtgaaaagatccatcctacctcaaaggtagggacctattactccttaaagttggcatgcttctcccttctatggacttcatttttggtttcagtgcattacataaaccatcctatcaatgaaatctgagccaaaactatgatagaaaaacaagggagtggaatgtttaaaagctaacacaagtagaagaagagcacggcaggtctgtgctggtttactatgctgtgtcttgcctgctaccagtttccttccctttcctttgcagtttgcgttaccaggcctgttacttcaacaaccactcagaacaaggtaatctcactttggacaataaatcagcagcaaccccatgccacgtgtacccccaaaataagatacatcaggctttcaaccaacttggttccctcaaatcttttcagtgattatcatagctttcagtcccaaagcttcacacacttgtctggtgccagcgtgtgaatgcaaaacacgtcataagggaataaacatgcacattcatagatgtttaaaatatgctgctgaaaaacatacatatcagaataaccaacatttcttacttatacttctttatttactaactatattttcagtactgacttggtatcaggaattgtatgagatacttttacatattaactatttttatgtttataatcttgtgaagcgagagctatcatttttgttataaaatttttttaaaccctgaaattttgacaagttaaatatccaaacatgacataaggaataagtagctaaactggaatttacatccagaataaggctaaggcaatatttctataagacacagattaaaaatcaattttccaaggaatgcataaagagcatgaatccttactgcctagtaacatatacgcatggattaatttatcaaaaatggtagttgtacccagcaaaggagagaaaaattggaaagaagggaagctggtaatttccagataggagacaggaatgttccagcttggctgcccactgagcaggacataagtgaaggaggagtaccccagagaaaaacagaaagaaaccagggcacaccccaggcagcaagaagtccaggggaaagaagatctcaatattggagaatttatctccctcaaatgactttccaagacaagtcctatttacattagcaaactccaaaatgtacagatatgctaaaccttacttttgctttgtagaaaggttggaaaatatgaggccaattttttatctccaaatatatgagcctctactattttcagtataactcctattgagggcttagttgaatcaaagcaggttacagcagggcatgacattagctgcacttcagtccagcccttgactttatagttgagggcaggtgtgttacaccacctgcccaaggctatgcatgtgcagtgagctggaaaatcccaggtcctaaggttcctttgctggtctattttcttccccatcacagcactagtagaatatctaagtagaagtaccatggctgaacctcacctaacaccggcatttagatcctgagatttgacaagtatttatggtatggcctgaaaatcatgcaaacaattgaaaacatgaggtaaacccacccctgtttcagaaaggtagtggatttcaattggttacaagatgatcattgtttccaatggaattctgcttcctaacattcctcttaaaatatccaggaaaaatatcaaacatgtttctttagttgttctatattatccttcaacaatctaacttggagaaatgatgggcctggaaagtcacatgggagtcccttccagacatgaagcctgtccaccacctgccctggcagccttggtcaccagctgcctccccatgcaggcccctgctcctgccttcactggaatgcatgcattctttcctacaatttcacagattggtggttagtatttaatgctgatttacattatggatatatatttataacatggattccaggatgtaaaaaaaaaaaaaaaagtggtctgtaccaggctgaccacattatctgagcacatgaaaatttctaaatgatagtattttaaatgaccaaaattatatgtatctatagttatcaatatatctcagtcccaaggccatcccactcagcaagcatcctccttcaaactacccagtataagaacaagaaagctcttgcagactgcacttagtgaagtagattaagctttccaaatgtggattatagtcatattgtatctagatatattgtatataagtatatacacaatacatatactgtattatacacaacacaatacatattttgtgtatatgtatgcagtgtatatgtatacacatgtatttatttctatatatctgtatacatatagacacacatatacatgatagggagagaaggcagagagattctaggtggacatgggagggtccctggagaagaatcaccctcaagcttaaaagcctgacagactgcagcccaaagtgacaacttatattctgttttcctgcttgaatgttaccttttcctaaaccacccatgttcccaccccaccccatcctgtgcctataaagaccccagactcagctggcagagaggagaagctgctggacattgtggactatggctggatgttggagagaagttggcttgacttcagagggacagtttgatggtgtaactttgaagaagaatctggccagagatgtccggactccaggggaagataaccttcctgccccatcccctttccagctccccttccactgagacccactttcattggcatttatcaccatttacctccacatttaccacccttcagttcgctcatgtaacctcatttttcctggacaccagacaagagcttggaaaccatgggggcagacacaaaagggcctgctgagctgttaacatttaagctatctgcaggcagcagagctaaaagagcactgtaatatgccctctggggtttcaggggtcacaggttccccactagatgttggtgcggggcctacagggagttggctcctgccagcatccaaaattgctcaccctggctcctgcatctgctcacctgtatgctccctccagcatggggtggaacacggagggtctgagtcagtggaactcacccctgctagtgccaaagtggccagctggttccagcgtgtgtgcactccatttccggcctcgtttgcacactccctcccacaggagttgagagctgagggctgagtaaatgaggcatccctatcacaagtcctgggaaggggtcagggaaatatctggcttcatacacacatagatatataaatataggcatcaatgtggtcattgtgtatatatatatgtgtgtgtgtgtgtgtgtgtgtatatatatatatatgtatttgcctaagtgtattcaaatagatattatagacacttaatagactacagtagaaagaaaaaaattatctcaaaaaatgtctacaggaaatgagtctgtcccatttatagaacttttaaaaaacaaaaatatttaataataaccaattagagaaattaaaacatttcgtatcacgaaaaaagacccaaaatagcaggaagcataaagcatctttcatttgcattttcctttgtaaatatgacactgaaaacacagcattttaaaaatgcaagcagtgctttttcgaatcttttctggtttctattgcagtctgttgaaagtgagtcaagtgttctatcaagtcttcatatgattttgttgcattaacacatagtatacctaacccatttctcacatgttcattgtagaaaaatattcacaaactacaacttttgcaaaaggtctacactctggatttggattcttgtgaagttcactgtttcatcttgggcaggcttcctggtggatgtctcagaaaccaaaaagctgtgatagctcctttttactcgatgagttcctgattgggtcttccttcaaacaccatttgaaaactacaagcttgtgtcacacatttttttcttttcttttttttttacatcctggaatctatggcataaaatgtatccataatgtaaatcagcattaaatactaaccaccaacctgtgattgtaggaaaaaatgcgtgcactgtttcagtgagggcaggagcagggacctgcatggagaggcagctggtgatcaaggctgctggggcaggcggcagacaggcttcatgtccagaagggactcctgtgtgactttccagacctaccgtttctctaagctagatcgtcgtcacaagataatactgaacaactaaacatatttttccttggtattttgagagaaatcttaggaagcaaaatttcactggaaccaattaccatcttgtaaccaattgaaatgcactacctttctgaaacaggggtgggattaataaattccactgttaccccacgttttcaattctttgcatgattttcaggccataccacaaataacttgtcaaatctcaggatctaaatgccagtgttaggtgagggtctggctactccagcccaaggagttccgagtcattcaagggttgcctcagacccacctggcaagtgcaaagagacactagtgaaaagttgtctgtaatctgagttcaaaatctgcctcacaggctagagttgccttcccttttgtttataactttcaagatcttggtaaattcctatttcattaaaccatctgaagcaattaattaggataagaaacaagctgataagtgcctgggttttattgctagataactcctagaagaagcaatttctactcatccatcaggaaagacagattttttttaaatttataagattatgcaaattcatatattataacacaaactaagcatgaccctcaaattcctggactgtgattaactttgtccttcaggctatgaagttggtgcccagcctgcccctcccttcaactttacgtggcttcaaagtactttgagtcacccataggaaactttgcccagtgcagaagggttttcattttgactcctgacctgcagcatatgattttaggctataaaatctaattgcaaaatctccatgttgtgacaaagaacaacaaaaagtaatttcccttagatttataactttagaattacaaatgatgttaatatgactaaaattacaaaaatgaacaatttctattcaataggcacttagattattccagaagtggccaaagtgctggctgtgtaaacagtgatagccagaagactgacagcaaagaaagccattcgccaccagataacgacagagattgcagaggaacgtgccagagatttcttagagccttagggtgtgtggttttaaaatatccagaatagttctgctacatattcagaatttgccagacctcagctttaagacaataaatcatttgcttaaggaaaatctctttctgtcacattctcacaattcacacgtaagtttcctgtctgcctcctcactataggaaaatctttagcttctaatctaagccactacttcttcagaccttaggattcaagggaagaagaaagctgtggaactcaggagacaagacagggtcatgcaaggaaggcttcttgcttgaagagaggtctaataagtcccaaggtggcctctttgccgaagtacagattctatctacacatcggaactagaacatatttgccaagtcagaccaaggtttttccaggaactttagggttaagcattaggtggatgtgcaccaaaaatactggggcagcacaataattcatgtacgtagtcaagtaatatttatttattgagtacctgctacatagaagaaccaactgtaggtactgcctggaatacaaagttatataagacagacctctgccttcaagacatttataatttagctaagaagatgagatacacacaaaagagagttaaactgaagaagataaatactatctgatcccagggaaaagcataaagatgataaatgctctaaagcagcaccatccaatgaaaatgtaatgtaagctgcacatgtaattttgtatgtcccagtagccatgttaaaatgctgttaaagagggttgggcacggtggctcacgtctgtaatcccagcattttgggaggctgaggagggtggttcacttgaggtcaggagatcaagaccatcctggctaacacagtgaatccctgtccccactaaaaatacaaaaaaattagtcaggcatggtggcatgcacctgtaatcccagctactcgggaagctgaggcaggagaattgcttgaacccaggaggcagaggttgcagtgtgccgagattgcgccactgcactccagcccgggcaactgagcaagattccatctcaaaaaaacaaaacaaacaaacaaacaaaaaaaaaacatgctatcaaaataaaattcattgaggtatctttgtgtatgtgtattctaagtcttcgaaatccttacacttactgcactggacacctttcaagtactttgaagccatacctggagagtggctacacgattggacagcacatacccaagatattaagaacaggcttccttggtaacatggagcctttgttggatggaaaaacaaattaacttgtcttcttagaaccagctgccatagaggtcagcgcaacctaatcaggcactgattccaacaaaactaccctgcatttaccaaatatactgatgaaagtaacacagtccttggaatttggttgatttaggttggaatctcacaggcagaacttttttctcgggaaccgtattcataagtgagtagtttaataatgggttgactcagcaggtctgcggtattcaagccaagcatgttccaagagagtgtctggtctttgactggctgctgggaaataatatctaagcccttacaatattctgcctgataggagtgtctctctctcttgacctgagatctttgatccatgccagatagtctacactaacaatgcagtttacagtggggacctgtggccaggctgcatctggttgacttcaggaagggctggagtctgagtaactaaggtcagccatgcaagcattccatgcttttgtgatcaaccctcaataaatccctggacaccaaggctacattgcatttctttggttggcaatattccattcattttgccaaatgtcatttctgggagaatacagtgctgtccttatgactgcaccgggagagaacaatctttcccaagcttttctgagctcaggatttatacacagtctttcctaagctttgccccacatgccttttatgggtgctaactttaatctacatctaccccatcactgtaatcaaccctaactgcaagtataaatgcttttctgagttctgtgagtccttctagaaaatcattgaacctgacagtggtactggagaccaccaactcaaagcttctccctcttgtgatgataagcacagtaaacacaataataaaacctgtataaatatccctggacacagatgtgttagtttggaagagtcagaaatatatagaaatcactgtctcactttatcagggcattatggtacctgcttatctaggaagagatccagttccctccaatagcatcagaatctcttaggcagcaatctttagcttttacaaagggtaaattccttcctaggatcaagcttgaaacttctttacatgagttataataggcatgtggctagaaactagacaaatgccactcatgatccagttccctccaatagcatcaaatctcttaggcagccagcctgtaccttttccaaagggtaaattccttcctagaatcaagctttctatgagttgtaatagatatgtggctagaaactagacaaatgccacttatgatataattagtgcatttcattgttatctttcttcacatattttatagcccccaccgtttttttttcaaaattaacataagaagtttattgccttatgtattcttactttgtactgtctcacagaaaccagtacattaccaacaaattaagaaaaaataatagacattccattccatttttcattattttattgagcaattaacactgttattcaatgaagaaagccaaaatgcaatctggtttgcataaatatttcaacagagtgggacagaagaaaagtcagatcccacatcatgagtgtccccagttcattgtgaaatacacccacacagatgaagacatattcttcgtctatggtgtccccatggacttccagacatatggactagctaaaaacttttggaagccaatcaaatctcaagtctcaaagctgtactctacttgcattggctttctctgtctgcaagggtctagagaccaaggcactctacctttagccttcactctttctcagactccgctgcttttcacttctctctcatcgttcattcaaggagacccccttagccttgctataacactgattctcatttctccatgttgatatcaggattccatcctgtctgaattatcttcctatgtactccctgtttactcaaattctaatgaatgtaacaggtcgggggggttacttaagagtagggtataagtttactaatatctgtgttctcttatctagtgaaatagtcttcaatgcatgtgttaaaaggaacatgggtcatatcaaagcagcatgcagtcctacatgtcatctgtattcttccttaataacctcactaacctccctcctttccaggccaccagacactaccaatctgatatatctttttattttattttattttttaatttgtatctatctatccatctatctagctatctagctatctagctagctagctatcgtctatctatctagagatcagtttatggcgctggctaatttttgtatttttcgtaaaaacaggattttgctatgttgcccaggctgatcttgaattcccaggctcaagagatccactggcctctgcctcccaaagtgctggaattacaggcatgagccaccatacctggcccaatttgatataccttgactagtgattgtgttcgagaagcacttatgaactatattctatcattcttctaatcattttacatgggattgtttatatccaaataatattgtgaatttagtgaaagaggtcatctttaacatttatgaaatataagtattagtctctaggctctaaaagagggattggcaaactatggcctatgggcccaatctatcccatcacctgtttttgttaataaagttttatcagaacacagccatgcccattgtttacatatgttctatggctggatttgtgctacactggcagagttgagttcagactatttgacctgcaagggccaaaatatttactatcttaccttttacagaataaaactataccaacccctgctctagaaaatcatagagtaaaaggctcaacaaatatgtattacagataattaaacatgctaagcatagtgttttagaaatgaaagaaagaacaaaagaagaaggaaggaaaggaaaggaaggaaaggaaaggaaaggaaaggaaaggaaaggaaggaaggaaaggaaaggaaaggaaaggaaaggaaaggaaaggaaaggaaaggaaaggaaaggaaaggagggaaaggaagggaaaggaagggaagggaaaggaaaggaaaggaaaggaaaggaaaggaaaggaaaggaaaggaaggaaagggaagggaagggaagggaagcaaaggaaaggaaaggaaaggagggaaaggaagggaagggaagggaagggaaaggaaggaaaggaaaggaaatgaaaggaaaggaaagggaaggaaaggaaaggaaaggaaaggaaaggaaaggaaaggaagggaaagaaaggaaggaaaggaaggaaagaaagacaattttaaagtaagaaggaaccacctctgggcatatctactcatacctcttccctaagactccagaagagtagagggtcttgctgaaattcacccagctagatatcaatgtggattagcttagaaagagcccctaatcgttcaccagatatcatatatctggtttatcatatatcacatggcatcaataaggaggagcacttccacaatattgcatcccatagttttatatggcatttaatatcttccggtgaaaatgataaggacatgcaggaaatcattaccctcttcacaagttgagtattttctacactttcacacaaaatcgttttgaaactccagctaattactatacttccatttcctctgagggaaaaaataaaataaaaagcaaaccttctggaattcctagcacagcctattagttaatattatctacagtcccataaagtcactggcctcacccccaggcttgctttggtatcagcagccccaagtcaaacaccaaagatgttaaactttaaaaaaagaaaaagcacgtgttaaaaaaaaaaaaaaagaaacaaaagctgacatttatggtttcagggtttttatttccaacagaggtggatttctgccacggcccagcaacccccagagagctcagcatgccacacctccaaatcaccagcctctgcaaagacaggttcataaggcaatgaggaaaataaatgtccttccattggctttgccctttttggtgtattttggccaatctcttcatgctttcatttcaaggtactaacctgccaagacccataagccagggggtataatagtcactcttgtttcccagcgtgggacgaagccatcacatggacaaactagaaagctgtatttacagccccactgacttcctgggagagagttgtgaattcaatgtcacagtctcatttctaatcttgtttccaatttttcttgacatgtttatattctcatttcctgatgtgtgccaaacagcttcagagacccttcctgctctgggcccagttttcatggtgtttgtcatggtgaactttaattatttgcttgaccccattaatgtttcttcactagaccgtctgctcccaggcacgtgacagctgtttgttcattcaagccttcgggcagcaaacgtgtacctactctgtgcctggtcctgctgtagacactacagacgctgcaggaaaacaagtagagaaggctgttcctctcattgaatgcttatccgaatgagggaggcagaatcaatgaaataaggagtgccatgatgtaactaaaacagagtaactttgtagagtgtgacttagagcaacatggtagagtctgtgaggaaggccagtctgtgcaggtaacatttaagctgagactggaatgacaagaaaaagccacatagaggtctaggcaaagggcattccaagagagggagttgtctggggaaaggccctaagctgatgatgatccagggcaaattaagcaagagaagcaggacaggagtgtaacgagagacaggagaggagaggtgtgagggaggtagggccactgcatgcattatcttgcaagtagaggtaaaaagctttggattttattctatgggagaggttggcaaacttgttgcaaaggtctggatagtattttaggctttgtgggaatatagtctctgtcataactactcaactctgcctttgccaccacagacaagagtgggtgtggctgggttccactaagacaatattcacaacgacaagtgggaggctgattcagcttgcagctatagttttgccaacccttgtctatggcactaggaagccaaggtatgtatatggaacagtcaagggggaggcatgagctgcgtggcattttttaaaaactcttaggactgtagcatggggaatggtctgcagaggatggagaatgcaggaaatgggatagaccacagtggtctagagaagatggaggaaaggaggcagatatgggaagcattttgaactaattgattagggaaataaggaaacgtgagaaactgaggataacacccgagattttcactagaacagctcaatctatggggtgatttctgagacaggagagatggagaaaaagtaaatttggggaacaatccaatagttctttcctggatgtctacgcggaggtcttcactagaaattgcaatggagaggtgagtaaggtgggaacagagaagtcctggagctcagaggggctgggcagaagataaaggtttggtagccctcaacataaagatgtcatttaatacggtgctagaggtgacatcgaggtgaggaacgacagaaggagaagaaaatggccactcattactgagagttggaagaaagatgtgtggagtgttctgcattagaacaaatgaatgcatgcagaaatgaatgaataaagcccacatccctgcattaggagggtcatcttattcctctctatctacaacctctatagttcactgtagaatttcagagcgatggctatgacgattttgatcttagaatcaatttgattatttaacgccatccctgatacataacccatttatcttcatacaggcttttaaggacttcccaattggattctgtttctactgacatccatataaattggaacctgctccttcccttcaattctttccccagaagtgagagctgatagccccaggtaagtccccagcccccactgaagacgcatttcttctctgagggttaccttgagagacagaggctctgttggttatgattagatggtttactaacataattgtgaacataatttgttctgatctgcttctgccttccagtcaacccacgttccgtatattagaagaagaaagggttggtgtgtgtgcatgtgcgtgcacacacacaagtgaagagtgtttagttctgcctgtctgtgcctcagggaatggaatgtaacagatgttacagtaacacacattttttgctttaagaaaaggatgaaggaggtggagtgggccaacttgtagacactttggattccaaatcaaaccagaaaaaaaagaaaaggctgcacacagttagaagaaagtgcaagcggaaaagaacccccaccaagttcaaagggacttgtgtttaatcagacaaaaacaatttttatagcctcgggagcccgtgtggtgtgtgaggaagttgtgcagcaggatggcattaggcactcaagccagcatgcttttgtgttattttcttctttctttgtttgcaaccggggttcaaagaaattcactgtgcaaaacagatactgaagtagatcatacccacgaattaacattgtcatgacaagcagctctgtgttatgagcaaaattacaagtgacccatcaaataaagcagttattgtctaagtaagagctcctttcttccaggattccaccgtgttgctagctttgtctcttccactgaaacgctcatgcacctgatatgaactccaagcagcctcctgaacatattcagtgagcctgacttcaagagaaagccccgaacgatgaggaattaccagcttgcaagacatagagaacccattccttctgaaaaatcattttccttcctgagcccattcacacagggctttgactgtttcctacctgaaggtcacatgcatggccaaatctccatctcattaattacaactcttggcaagccattaaaaatctcatttcattttaccatccaacctccttttaactgacttttcataattataattctatttttgatatactggacctattaaatttaatgccatacagagattttagaactccttaaaaaaagactcaaattggactgtgtccaccaaaggatgtgtagtccttgcttaggaatatgaaaggggaaaactgcagtgcattctattttcatccacagaggaagaaaagtcaagctaattgcatatggtcagtataataatgctgtcattctagaagggctataattagcgagaattgttttcacaaacaaccgaccaagcccatgactccagcttgcattagttcttttttccccaccagttataaacatttctatttttgctcctccccaaacataaacattactccattaaaaatacccagggagaggagatcctgacagtataactgcaaactctgggaatagacataagcctttttgcaaatgttgagtctgttaaaaggattagagtgccaagagagggttggaggaactattatccaacaagctaaactttacctggtaacatcaaggcgggaagccccaggtgaggcacctctcctggacagagaggagtgagcactccaaagccccatgtgaagatgaggggccattgggatctttcacatctgaagatatataaggcaaaacttacttagctccacgtcatgtcgtacagtatggatgaataactatggacaaaattctctctcactttaaactacagttatttaacaaacattatttggacaggaattatgatcagtgcattttccagtgctgaaattcaactaagaaacagggattgttgaattttgtcacactagactgagacagtggatcatctggagtatctagcactgattctctccccaacatatgttcagagtcctgttgctccagcttctataacacactttcttctgtccccactgctttttgtttggaccctccatacctctcattccatcactggttgtccacctatgccaagtctgttccttggtgcctgggcgctccagtcagcatctctaacatgaaacctcaataagaccaaagccactaagaaccacactggctccattttaccttcaaacccattttcagtgctgtcccttgtgcaattttggttctaactgtagtgagtgcttttggtccagggaccacccagagctcccttgacttccctttccttacctggtggtctgacgcctgtcgttctgactccagctgggatgacagctgccacagaacctctctgtgcatctccttcaacaagaggaagggtcttccctgtgcacacagtgtccagaccttgcctctcaggtcctatgctgcagcgttcaatttgtctattgacacatccatctttccactaaatggcaggtgcgctgctatgtcctacactcccagtgcctaatgcaaaggctgccctgatgcaggcacttgataaagatgtgattcaatgaatgaatggatgtgggttcaaagagtggctgaatgaataaatgtcaaacacattgatgaatgaatgaacataagtcattcagtgcaccctctatgttgaaagaaacgaagctggaaaataagacaaagcttgggatgctaggagagagttctttgaactacatttggagcatacctgtcctctatgctatgacaaatatgcctggaatctagaaaaggaggctctaggttgaggcattgaggtacatgatgagataattttctctcaaaattttttgattcaaggagcaaagcactggttcagaccctcttgcaaagacagtaggatgtggggctatggaaaaactcaaagtgaaaaaggtgagcacatacatgttaattagggctcagtccatttcctctcctagacaggcccccagatcctcagcagcagcacccaaaccagacacatacacactcacggacacacacacaaagcaggaataccacagtagcagctcctccccccaccagctagaggctgcagaatatgagaacctggcctttgcagtgtaacaggccaggaatctagcctctgctctgttccataagcaccatgggttcatggactagttaattaaattccttagtttttttcctcagctacataaaaggggaaaaatagtcactttatacaattttataaagactgaatggcatactgtatgtaaggcactcagtaagcatttgttgttggattgctattgtgaggcattgttgaacttgacattgctatgctcagcttggcttggtgtttatccagtagattccctttataacataatggccagaataaaggaatggccagagaaggaatttcctagcataaccagactgaagctgagttgatgataggttagacatctatggaatctgaaatgagtcagtccttcctttcctgaaggtcatgatgtaacttttgcacctataataactattcccctacagctgattttgctggtttttaagtcaaaatttaaccaattccaattaattccgtctttatatttgccaccactccatgttggcttgttaggcaattaagtattcaaattagagtaactctcaaatatttccttgcagaggaaaaacaaagaaacaaaaaactatgaaaaaaattaccctttaaaggcaaaatgtccatccagttttgaagattaagaaccactggggcagaagagggagaatgacctagaattcagaactgcaatgataaaattattcctttgacaacactaggtggctgattctcctaaggttgtctaatagatttaaaaatttttgctatccttgttttatggaaatataatgagaaatatagacatggttttgtttagtttttaaattcaagataaacaagaatttcaactgtgacattatctctcagcaatagcctttgaatctcttgtgttgttcaatgaactactcactagatgaaccactggcctttgcaggtattaacctctgcagtaggtcatcctacttcatctgtactgttagtaaattaatcaaaagctagcatcaggtatgcacacacctgcagagataatgtgtacagtgttctccagagggatgggatttgattctgtaggtgacactgatggaatacagcagtcagggtcttaagaaattggatagattaaatatatcacaaaagagacattttaatagtctaaaaatcagtaaaggtgtttttcaaaatacatataattgagaaaatatacactaccctaaagagagagtagattatgagatagagatgcaggaaagaactatctcaattgtgtcccccaaagcaaataaatttttattaagtccagtaccttgctttttaaaacaacacgatagcttacaaaagaaatgaagctttagtacacactcttggaaataccttttcagatgatggtgaaaataataaaactgcaatgaaaataatgacacccataataggacacactgggtgcatacaatattctcggcactaggctgagcaacacagtgggtattttacatacacattcctgaatccttgaaaaatccatgaagccatgtattagtacttacattattcatgcaagaaaactagaactctaaggaaaagcaagaaacacaaacgattcttttcattttataattttctttatcagtctgtgatttatcttttgaatgcctgattttctatcttcttcatcctaggggagagagtattaagttctttaacagcaaaggattaaaaacatagtcattctctccaccaagatctataaagtattttttaggggcataacaataaataagacagaaatcttgccctttaaaaactcaagtctggccaggcgcagtggcacatgcctgatatcccagcactttgggaggccgaggcaggcagaccacctgaggtcaagagttcgagaccagcctggccaacatggtaaaacgctgtctctactaaaaatacgaaaattagccgggcaagttggtgggcgcctgtaatcccagctactcgggaggctgtggcacgagaatcacttgaacccaggaggcagaggttgcagtgaggcaagatcatgccactgcactccagcctgggcaacaaagcgagactctgtctcaaaaaaaaaaaaaaaattgcaaacaacaacaacaacaaaaactcaattctatgcagcatcacatactttcttccttaaaaataagacaaagacatggttctgttatacagaaaggagggaaagtgatgaaaattataccagcattaccgccattttttctgtgaggtaggactgagtcacatatatttttatatgttgtgagttctagataaatacttaataaatgtcttactctgggtttaaatgtgagttaatctgttcctccctatgcatcaccttctaagagatttcctcagcattttcatccacctcataatgctctttctcactacgtctatactctgtctcatccacatcatgatcttttgctctgaccatattgatgctactaggttggtgcaaaagtaattgctctttacctatgtatctctttaaacactttcaagtctgttgggagttggtctattttgcggatctagggtccaaattctgtcactgattgttctgctgatgcgcttagttccattcattgtttcattagtgggtaccctttgacttgagttcaccatcaccaagaagctgtgtttacaagagccccaaatccagaactgagaacactgccatgggcatgaacactagagggcgctctcaaactcgaagatttggtgttaaggcccctgctggcaaggaaggttcttatttgggtacctcgtgggaacctagaaagcaggcttgaggccccagtttcgtcttcatgagacaatgtccacccacagccatcttcctcttctcgtcttggggggtgaatctgcggttcttttgcgttttccttttgcaggtagaacagctcactgtagcttccggattcagtttctggcctccctgctcatcaggctcaagcctcacctgcttctcccatccctgagcatgtttataagccccagcccccagaggcatttcaacttgggttcctactgaggattccagacttgacctctcttttttatttctgtcccctggaactgtccctttcttgctttggggacgctattttttaaatgccattatatgagggtaagagatttcaaccatcaactcggcctactgttttgctggaaatcttacaaaagaactatcttctgtatgttttcacctcaattccagagtaactagaaatactaccctacgagggcagagacacttagtttgaatgcgattccaatgttttcatgctgataaatatgaacattttaaatcttaagggaagataggtagttttaagtccgtcctttcaattttacacctgcatttaaaaatataatttaaactactatttaaccattaattatatcccaaaaaaagaggatatgaaaacccgagtgaacacagttaatgtacttgcccccatggttttgaaacccagcccacacacttcccaaactctgtagtatgctctcatgtctagatgaatatcaaatgtaagatgatttctatggttaggagctgagttgaaagcagaaactctttagtcttcaactacaagtttcatttttttatgtgcaaaagtgtctatctgcaaatgcacaaatgagaaacaacagactggctgaaaccattcagcaccacacctggctcctagggagtgttcaggatttctcagcgactgcctcacctcagcataatatttgtaatgcgtcttactttttacttttgagtttatttctttgaatagggtcaggaaaatccattaattaaagattccaggactctaaagtacatttcaaaaaagcagaattgttcatgagatcttataaccatcctaggttcttcggatattactttgtgtggttatgtggccagaggagtttggtctcagactataaaaggcataagtctttctaatctgttcataaccaaatatagcacacaggaaatcactgcaaagcgctgatataatcttttctgttttactccatctgaagatggttcctgcctgaaccatgcacactaatcatttaatgttctacagaagaaaagaacaaacagagcagggaggcagatgtggccacatactggatctacacttaaaacagtgaatggctgctacccccacctcctgcagtaggtaagggggggtcataattacatggtggggtaggaatgggtcaaaagcaaattgcctgagtgagagaagttctagaaggtcacatggtgagactggctgaaaagtacctccagaactagcaaatgttttcacttggcttgaagtcacagaaagagcattgcagcataatagaattacacatcctttgggagatatccttctctcacttggagtgtgaaattcttggtgatatcaaccgaagctccacatagttatggaggtaaaggaaactggaggctttgagaattacaaaacataccacagatggaatattatccaactatatttcttgcctcccctaaacatcagttacacggttctgtcaagagactcagagctgccaagggtcagttgctcagttgtagcaaaaactattttcaattcatggaatggcatgactaaatcaaagaaaaataaaataaaaaggcatttcaagtggccagaaaacatggggcatatggaagtaggcaggcgatgaggcaggatgttcatgggagaagcacagtatttcattagctcctttaaaaaatgttgctgaagaaacctggggtgctcaaatttggctcagaaggaaggggaagtcttaaataagtatagtaatgataaacacatgcaaagttcactataatcttcccactctttctttccttgctaagttaatttttcttatagcaggcatctttaacaaccatgtaaatttattattttcatatgttctttctttattctctctaaattccaaagattgcccttaagagctttcaaaatctgaattaaatcagagaagacattgaacaattttgtgcagacacctttgagagtgaagaactatatcttataaatggtgtgaataatgcctttggcccttaatacaaacttattttatagccctgaatgtaattcctactacatatctatattagtcaggcttcacaggtctagatgaaattcttttcatctaatattttcactgaaggagcatagcttttattcacaaggaacatcctaataggattttaaagcttttcccaatgagagatggcttgcttttatcatgctccttgaggagaaaaaagcttaagaggtttcaaataaacagcttatcaatatcaaatattatttaatcagaccaaagacatagttagattaaaattataagaaggacaaattattgtgcaccagctttcataatttttaattataatttctacaattttataacgtgagttatttgaaaacatacttagctattcctaaagagagtcaaattcccattgttcatctcaaaagtcataaaaagcaccaacagatccttccattctcccaaacttgttgtgactcatatttttgaatttcgagtcattcaatgtcttctaaaatacaaaaaatatattaaaatgaggaattatttattttcttctttgtatctcagaattgattgggaataatttgcaagggttgagttttctgtttcttgtcaaaagagtttctgttcagctatttaataaaacatgtattgagtactcattgttcagaaagagcccttatgtaaagcacaaggtggagtatacattttatttactcaccagggttttatcacaggggagacagacatattccacaacacatatataaggatacccatttctgtgggcagatgcattagaaaatatacagaactgacaacacagctgaggagaaagctaaactaccgtagtacggatcttccttgctaacagaacctgattttgttaaacaaccagggctggagcaagggcaaggctagtaagtacctcatttggagtgtaaaatttcaggggatcaaaaaatttcagtaatcaagataaataatattttaatataatatttttcaaggtctagattaatgcaaaaatccaggaggagcaaaccatcaacattttgaataaagaccctggagccccaatggggctcggcaggagactgtactgatcctgtctttatttaaaatctagagtgctgttcatcattgcttgatttttttgcattcagatagctttttaaaatattgcattagtatattatttatcttgattactgagtgtttcagcaccatttaaatagtgtacccaagatgagttcctcactcacctaatcctggtcccaggcctgctggactcaggacataaatggtggtttttttccattctcccttgccagacacttccttttcaattacacctagaggcagccacacaaatagctctggccattcatatgcaaacaattctgcacatggcttcatgtaagatttggcttttgttgttgatttctgatactaagcagagagcaaagaagctggttgcccccaccctcccactactgcctgtctctgaacactgccagcagccatcctaacatgaaataaaaaccaagggcaagagccaaccccgtgaggattattgagcaaaatgacagcacttgggtccttgctgccactgttgagctctgaaccagccctgcactgcttactctttgcatctagttaggagacaatgaacatccttatgatataaaccacaattagactaactatctattacctgaagtcaaaatatttctaatggatattctagcttaatagccagtgagctttcggggtaagggtttctaaactttactgcactgatgacttaaaacatgtatgttaatatttcatctctgaatcatttgcttctaggtagtgaagcagtgcaaattctcaattggaatatggctgtaatctctttatatggcaattaattgtggaaatgtatgcaaattggaggtcaaaccatcattcaaataaaatatactgattttttcctactaaatatttgtgacaaaaatgccagtgtcaataatgtcaacagaaatctccatttttattttgctcctgcaataaagaattctttttttttttttttagatggagtctcgctctgtcgcccaggctgaagtgcagtggtgcgatctcggctcactgcaagctctgcctcccgggttcacgccattctcctgcgtcagcttcccaagtcgctgggactacaggtgcccaccaccacgcccagctaagtttttgtatttttagtaaagacggggtttcaccgtgttagctaggacggtctccatctcctgacctcatgatccgtccgccttagcctcccaaagtgctgggattacaggcgtgagccaccgctcccagccacaataaagaattctattgtgttgttgtttgaggatgaagaaaggagggaattttcctgaagagataaagaatgtcccaaatgtcccttatgttcccttatttccctagtttcaagagcaatagaatcaatgtggtaggaaccttagatatagtagccctatgggctcatttttcacttgaagaaattgagatgaaaatggaacacaatagattttctatacatcagagaagcagttaacagcagattcacaacaattgcacaggtttcctttcctagtctggtattctttaaacatgaaccatgatgctttccaaaaaattgactcagagaggaggccaaggcacatgagtctctgagcagaacagcctacatcgatcttcgttaagtgatgctggaaggcaaaggtctataattatgctatccaatatagtagacactggcaataaatgactacattttaatttaactaattaaaattaaatacaattaaaacgtattactttagaagtaacatttcaatcctcaacagctacacatggctaatggctaccatatttgtcaatacagaatatgagcatttctatcatcatagaaagttctattggccagcactgctttatagccatgagttctcttattgttctgtttctaattgtaggaacaggaagaaaggaaggatcacctatagaaaactcaccctgaaaaggtaaaagaagaattgcatgcattactacaaaagctactcaggctaaatatgtatctctcttatttcctctccatggttaatataatatctattattccaaaaagtatttttatcacttaaattcaaaagcaatctgaaaatcaacaattctcaaatgtgatggcacctctgaaagtggtatactcagaaattttcctccagactgcctttgggagttaaataaattaactttcttatgccaagttaacatgaacttagcccttaaaataactttgtgaggaaaactttactgataaaacagtctgatatagtctggttgtttcttctctccaaatctcatgttggcatgtggtccccaatgttgagggtggggcctagtgggctgtgcttggagaatgggggaagatccctcatgaatgatttggggccctctttgccgaaatgagttcatgtaacatctggttgttaaaaaagagtctgggacatctgccctgtctctcttgctcccgctcttggcatgtgatatgcccatacccccttctccttctgccatgagtaaaagctttctgaggcctcaccagaagtcaagtagatgttggtgccatgcttgtacagcctgcagaactgttagtcaaataaacctcttgtctttataaattacccactctcagatattcctttacagtaatgcaaaatgaactaagtcacagtctatggtgggttttcattaaagataatcttggatttcaagtaatttgctgaaacatgtacacacacatacacacacctaggtcttattaaatgttacataacacattattcagaattatctttcacattgtaaagttctcacataatgcttggacgtgatgcccaaaaatatgtggcattgtatcctaacaaactcaggctatttctaaagcaatatgattactggatttgacactctcgacaagtttatgcatcctcatttgagttgggactaacgtaatttcaaaaattggtttcatagaggtattatttaggtagaataatatttactcatttaaatgtaaaatttaatgacttttaacaaatgtataaaacctgtcaccacctcttcatcttgatatagaatatttgcagcaactcaaaaaatctctcgtacaccttgcagtcaatttcttccttgaccctatatccaggcagccattaataggtattctgctgctacaattctatcttccacagaatgtcacataatgagataatgaatacatattcttttgtatctagactctttcatttagcatgatactctgagatttcatctagcttgctatctgtatttgtagtttgtttcctttttattgcccagtagttctccattttacataattaatttattcatttccattgatgaacttttgggttgtttccagtttggagtttttaagaataaagcttctataaacccttggatacaaatctttctgtagacattattcaatattatgttactgttgggaaaatacctaggagtgaattttctgggacttattgtaagtatatgtttaacttttgaagaaatgtcacatttcccaagtggctgaatcattatgcatcatcatcctgcattattaacaacaaaacaagaggtccagttgtgccatatccttgccaacacttggtattgtcagcctttctaattttagtcagtctgcagtgtgtgtggaggtatctcactatgcagttatgtctaaattgctagtccatttttaaaaattagattgttttcttaagttgtaagactttatatatgctggacacaagaccacatatatatatggtaaatatgtgtatctctgtgtgtgtgtgtatgtatgtcaaatattttgcaaatattcccacacagtgtatggcttgcttatccattttcttaatggtgtcttcgaagagaaaatgcttttcatttgaatgtggtccaatttatcaaattttctggtatgtgcttttcatattctagctaaaaaatctttcctaattcaaagttttggaaatatttcttatatgttttcttccagaggtttttaaatttttgctcttaaccttaggtctgtcatccctatcaggtaattgttgtatattgtgtgaagcaatatttagagtttactttttgcagagagatataccatttttccagtaccacttgttgaagactactattttctcattgatttaccatagcctcttcactaaaagttaattgacaatatatatgtatatgtgggcctatttctgatctctgctttctgttcattgccttatagttttcctcatgcaattacatcattgttttgagttcttgtagtgtaggtcttccaacatttccctgcagaacaaaccaaaaaaaaaaaaatggcagtgcaggagcttagaggcatacctggttatcattatgaaagttccatcgctgatggaacatgtgtgattagatgaaccccttccttcacttaacccattccctgccttatatttttcctcaacccttatcactatgtaaccaattctactacatgtctatatcttattattgtctgactctcctaataaaatgtaaactcagtgtgggccaggatttatttctgttttacttcctggggtaaccctagtaactaaaacaatttctggcacataataagcactcaataaatattgactgaattattaatgaactgggcctctgctttcatctttaaacaagtaattctctgtgctgaagccagagaattgagtggcacaaaaaatcaaacatacaaatgagaatgacaaccgttaatcaccttctgagagctgccatgagcactctgctcagccgttcctggcgtcagggtcttgcttcattgattttagttagcagggtttgcagcctctctaaggcacacccagacatattttcaaggtaggatgggtcaaatagtgttaccccgactttttacactggggattagaggaatccattcattttggtgctttagcacacaacatcactgtggatgacagcatgagtctggcaggctcttaatcatgaataagaacactttctcactcatggaacatgtgtgattagacttgcccctgagtcatatgaaggaattgggagagcaaaagagaaattaaagaataaagctagagattacctcccagcctctctttagtcaataataaaaaagattcaagaaaatacaaatttaaagtgttgattaaattaaaaaccaaagtaaataagatttggaaaccttcatgcagtctttttctgttgttttgttggtaacagagagacatcaccactgctatccactggagatggcataagctttgtctcccaaatgtaaccaaggtggcttaccttgtgctgatataaagagaagaaaggaggacataatccaagaaagatactgcctaattaaaactttactcaccccacatttaatctccaactcttcctctgtacataaaataaggatttttatctaccttcagtatgacaaacagatgaattgcccatttaatgcttagaaagattataatatacttaaagatagataaaatacaataacgtaccatttgaggccaaatggaaacactattttaaatcagaattctaacagtaactttacaaatccttattcccagttttaactcaatcaaattgcacaactttacttacaagcaatccactcaaagacttaaaataataaaaactatctccctattgagataaatcaaccaaaaaacaattgaaattttacctgaagataaaatataaatattcaatcttataaattatttaattagtggccctagaacgcaaaagtaacatgaaagttattaataattttcaaaactcaataaaccattttcgtcagtctaattattgcttataaaaatgcacaacagggaccctctcaggtctcatcagccaaagatcaataacaacattaaagtccagtctaagtattagaaccaattctctttgttaataacttatagtggttacatgctgcattttctcctaacatctctgtgcactcatgaataattattacatacctagattatagaattgaaaagtggttttttaaaaatatttcatttctccagatagaaaactgacaatatattttaaaatcagaaatgtatcccaaaatgcattttgtaatgtaaaaagcaggcaatgtggttataccttagctggttcctttgcaaatagattaaaatattttgccaatgtgattttgacattacatcacataaaacatccagtcatatgcatgataatgaaaagacaaattattcatggaacaaaggatatttaaggatccataacagcacgtttcctccccaagtaaactcttaagaggataagtcatatcctattctgaaacaagtgaagatcacacttggtttatgtaaattttagtttacagagaaaatgttgagttcaagacagttttcaacagttagcagtgtcttcctatatgttaatcagattcatatgaaaatgttaaaactaagtattaaaattaatgtcatgctatctatttctaattaaaataaatgttcttaattcctccttggagaaagtaggacattatcatgcaatcacacacatttatgatttctaaaggtcacagtggtagatctgagactagatgaacagagagaaatactggaagcagttttacccaagatttatatattcagactcagaaacctctggaatctcacagggactcgaggaatcctctactgcagcctgtcctgtggcaatgaggttgctgtatcctaatgaagaggctaaactcagccagtaccatgactccacacaactgcttggtgcattagacaccagacagccaaatcccagagaagaaacagagcatcatgagacacgcatggagccatgggacacgcatggaactgtgggacacgcgtggagccatgcggcatgcaaggagatgtggacgtgcatggaaccatgggatatgtgtggaaccatgggacacacatggagccatgggacatacatacatggagttgtgaacatgcctagaactgtggacacacatggagggatgggatatgcatggatacatggacacacataaagacatggatatgcctggagctgtgggacacacatggaaccatagacaagcatggagccatgagacatgcatgtagctgtgggagacacatagtgccatggcacatgcatggagccatgagacacacatgcatggagccatgtcacacacgtgcagccatgggaggcacttagatggcacatagagggagacatggatatgcatagagccatgagacacacatgcacggagccatgtcacacacatggacctgtggacacacatggagcctagcacagaaacatctccttcactcatccagcatgccttcattttctgagaggttacagtttgttgtaccttgacactgtccgtgttacgccttctccagccgcaggaggagcaggtggcaggctgagcaatgccagtggcccacaagacagcacggggtcaagggaagagtgacaggaggccagaaaacaggcaagaagggcagttatgatgacaacatgtaatatgcacatggccacattagagaagggcagaaagagcttcttagactaggagaggggctgggggcacagtgagtgaatacgagaaagagccaactcagagttacaaaacatgtcagatattcttcctgtcaaaatttaacaaagcaatgcatgcaacacacacataaatataatgtaatataatgatatgttttgaaaggaaaatataggatccatgaaaaataatcattcatactgtgatatgggaataaaacccaagtttaaaatcctaattggtcactttcagtcactgttttttcaatcatctaagactacatatggggataaaggcagctgttaaaacccaagttccttagggaagcagcagaaaaccaagtgcaaccccctagcccagtcccggtgatggcccaagctggagcagtcatctcaattccctccatgcccttcccaagccactggagctaaatgttgcaaatcctctatcacgagtccatgcagctcttgcttaagtttcagaacaattctcaggccaatcaataaacccataagtaggaggacactctacaggaacattaaggagttaaagataaagatcgctgggacctgggaatggaaatcaatagggccctgcctgattctgcaggcaggagtaatcttaggcattaatgctaaatgctgccagctaacaccctgaagaaaggcctccaaatcagtcatatgaaggacccacgcaaagtacagcatgactcacatcactggtggtctttctttgtgaataatgtgaaattgcttcccacaaaccaattcctataacaggagcatgctctctaaatagccagcatactgagtaaactttaatcaataaacaaacaaaagcagaatatggcacattgccttaagtagacattaaacatttaaaactaatttcagagatggttttgagactcagtaagcatgctgagaaacatgctgtcttgaagggtcactatttttcccctctttattggaatagacatttaaacaaatgacaaggacatatgtgtgaacggtgcatctgtaatgggtcagggtgttttagcagccactgcacaatcagggctaaatattccagaacacagagtcaggcaagtaaccttgcaaacatagcaagctgttaaagcgtgttatgcaatgaactccactagacaggaggagcctgcagtggcaaatatttcacagaggctggaaaaaaaaaaagattctaccagcatcttctgcctagccaggtaaatcagatcaagactctgacagaacatgctaagttgcatgaagacgttccgttaccatccagtccttcatcagtagcatcctatgcagaatgcctccagtgcataatactatctgcatggaaatcaggattttaagtcaagattatccggttctccctttatttccccttagtcagtgtttcatcctactttctcaaagtttcttggaatggtgccttacaaaaaagcgttcacggggagtcgcagagaccacttgttcagctgtaacatgagccatttcaaggcctgactgggtgcataacatcacaagacatcgtgtgtgtgtgtgtgtgtgtgtgtgtgtgtgtgtgacagagagagagaaaaatagttttattccctcctcagagaagcacttcctttctaaggccctgtactcttggcctggggcctgcctacccctcttcagccaagacagagatcttcaggaactccttcctctcccgcacccacccccacccacaagctttcctgcatcctgggtgctttggcctcctgccctccaggctcactggaggtggagttggcttcctataactttactgggcacctgttcccagttgctgtgccctcctacagcaccggggtctctgcttaaacaatcatctcccctctcttctctctctttagcctcttccttcacctcattccttcccatcgccatttgaggatggttaagtcatgctctttgaaaagctgttccctgccccttatgtccttgcatgactgacatgaattctctccttttatatctatcatctagtccctaacctttgatatatccccacacatatcaccatctggtttcttcccccaaccctgcactgaaactgctccgataaatgctgccttttatgtgtcctcccaaaagatatactgaagtcctaaccacaggtacctctgaatgtgaccgtatttggaaacggcacctttgcagacaaattgtttaagatgaggtcgtactggattaaggttagccctaagttcaacatgacttatgtccttataaaaagagaagacaaaaaggcagggacacagagggaggataccatgagactacagactaagagactggagtgatgtgtccatgagcaaaggaatgccaaacattgctgacaatcatgagaagctaggaggaagcagagatcggttcttctctagagacttcagagagaacacagacctgcaaacaccgtaattttggacttctggcctccagaactgtaagaagagacaattaggttgttttaagccatctagtgtgcagtaatttgttacagcagccctaagcagctaatacagtactgctgacagaatttctcagaaagtgacgaattgtcctggctttcccagaacagaagcaaccaggaaagtcccaggaagaccaggacaagtgtgtcactcttccttctggcatacacctgccttgaacactctgcagtatctgacgctctgctggacatagccttcttgaaaatatccccattcttggttctcagaaaggcttgccctcaactagataattccatctggtggctcacaggaactcagccttttccatctaaaatcaccacacccctcttatctgctttctcttcttgattctatatggaatcaacagccaagaatgtggggattgcagtcagggcttccttctcattcctgctctacatctactgaatcctcaaccacactcctttccaatttccagaatctacttcttctctacatttctgcctcccttcccttaatgcagttcctcctccctttggtctcagtagcagcctcagaatgggctgtccctgccggcattttgtcatcctccagataaaggataaacttattcagatgacttccaatgccaggcacctccgaatccccacttgccatgtgagcctcatgccctccacctcctcctccatatcgtaaaataagatgtcctgacttcctgtgcgtgaggcttgccaggacccgcaatgctccctctctcacttcagggcttatcacttgctcttttcctctccctggaaacctctcctttcataagttttgtaaacaccttctaacaatcacttgggatgcagttctggcatggcttcatcctagaaacctttttcaaccaccgtcctacagcccaggatgtgggcttagagcccctctcctaggctctgcagcacccaacacaggcacctgttaggacccttcacagaatattacgcaatggcccttttggttcacattcctaaaaatagtctaaacccttttaacaggaactgagcatcttcttgatctcctcaatatctagtaaaaaccctgtacacaacaggcttctcttaaatgttcattgaaggttcactccgaattaaaaacatgcaaataaaaatacactgagatgccatttatgcactgagtttggtccaaatcccaaagcctgacggtgtactctgcaggaaaggcggcagagaaataggtattcatatccagggcaactagaatgcaaagtggtgcaacctctatgaaagagaattgggcaacatttacaaaacgacatatgcattcaccctttggcccagaaatcccaattcgaataatctctttcaacggtacacttgcaaaaatattacataatgtttacaggaggcattactcactgaaacactatccatggtcacaaatggcagaaaataacctaagcatctctcagtaaggtgtttttgattaggttagggctcatcacatagtggaagctatgtagctaccgaaaaaaaaaaaaaaaagaatgacatcaatctctacactcttctagagagtaggctccagcatatatcattaggttaaaataatgttacacagaaacaagtctatataattgccacctttcatctaaggaaagagaacataaatatatatttgtatgtgtgtgtgttgctttgcttctattacaaaagtagcctaacccataaaatataggtaaatagctaaatgcagaaagagctctggaataggatcaagaaaacaggaagcaaagctagattcctttgaacaccttttgcttcaataattaaacaaatgatagtaactgggtcttgggttggtgccataaccacgcagaaagaaattatttctactggttttaaagcagtaattttgctaatttcactaaaattttccagtgaaatatatacgcgaggacaaaaaaaaaagagagagaaaaaagtcattttaaagatttttcaataatccaaaacaactaggtttgcatgaagctgttattctaaaatgactgtgtactaaagaaaaaaggcaaagaaataattaggttggtcagcagagacttgagattttgtgcaaggaagaaatagacactaagatgggaaaggttaacaaagaccctagagtcctggagatgagttgggagtatcaggagaagtttatggtatgttttaaaaatgcttttgttagcactgtccactgagaagacctgtgggcacctttggtgctcaaagcatacagaaatgagtgattcccaggtctgtggaaggaaataagtaaaaggaataggaacatcttgtcaacccagagagtaaagaagctctcaaagatgacttggatggagtcagaagagtccagaagctgctctcaagaggctacactgggcttaaaatgctataatttcaccatgtacaaggatgtaaactacatggattaaaatacatcaaatatgttgaaattcatgtattaataataattataataatcaaaataagaaaaaggcaaacataacatcttattcatcccctttggatgacaaatgaatgacctgtgggatgttaaagaaccaacctacttgtgtatttaaaaaaaaataaaagtataaattgatggggggcggggaacatttattttgcctttcctgcataaggtgtaccttcaggatacgtaaagagttgatgaaggaaagatagtttatatagaagtattctaaccattaaatgagcaaaataataaaatgagaaaatcccagttttgtacccacagatgaatcagtagattgaggctgtgatcatcaatgactgatcatttcccagctggatatgctctgcctcctgaaggaaatacgctgcactacccatgacacggtcaagacaaaaagatccaaacctggatctcagcaggtgtcttgagattactaggaatttacagacatctttggaaagaggaatatttgaagcacacaatcagaatgcgatgagcaaactccagactgtgggaaactgtccaggacaaagaacttggtttctgtaatttgcaaagggtgtgaaataaaagtaaaatattaaaagagactcaagaaatataccaaccaatggcagtgcatggaatttacttaaatctcgatttgacttaactggccaaaagatgccgaagtatttatgaacccatgaaagatctctcaatgccctctgggtgcttgatgatgtcatgaaatcatttattatttgtttgtttgtttgctgtgataatggtactgaattccttatctttgagtattatcaactgaaatctgatggataaaattatttgatttttttttaatttcctccaaaataatttaatgggtatgagatgaagcatgagtggaaatttagatgaaaaaggatggggatgggccatgaattgataagtgtggggctgcatgctccttagactattctttctttttttgtgctccttagactattctttctatttccatagatatttgaaagtgtttgatacaaagttttaaaaacaacaaaatataaaaccacttgttgcatgaattactgaaatacaatgtctcattcatcatatttagcctgataatataattccttgaggacagagatagagtctattttcttttccactctgaatgcttgagtgccccgggtgtgaaggaccttaaataaatttcaatgaatgaaagaataaatgagtggatatacagattaattatttaatcctaccaatccatagagatacttgggacattaaatcaattctgctgccatgcaatgctagatagaaacaaagggctaggtttgtggcaagactaaggctttgcagggaaatgccatagtgaagaattttaggctttccttggttttgttgttatttttatggtcacatttttatcctttggttcaaacacttaggaggcccacagtacctgttaaataaaggtgaccagaaataatgagatttttttaccttggtaatccctgtcttagatccctcttgaggtggtaatcagtttctggatatgaaattctaatgatagaggcttttgtagttttacctttattttaaactgtgtctgaaacaagagccactggattatacagcattcgtgatgctctattatcttctatcactaaacacagaatgtgcatttagatgacggctttgcaatcagtgcgtgctggttccttacctttataggagatgactggatgctcggttctctggcactgagtcgtaccctgggcctctgggtgggcgagtctccacagccccaggcttgagaacagccatgctataacacaggttcccttcatggtgggcaaggggcctctgactctgggcacgtgtcttctaaacagaagctcttcttctcctcatgtgtggaaagtgcctaaaacacacaaaagagaagaatcagatgactgtgagttcgttttctggtgggtggtcttctggtaaaacttcctcactaactttaaggttacactttgtggagatagaggagagcttggagggcttagagcagcatatttttctagtcatatcccaggtcgtgtgtgtgtatgaatgcatgcgtgagtgcgtgtatctcaatacagacctctcattctcccaataattgcatgacatagcccatttgttttaaacgagaaatgctcaagcttaagctgtactgtcgtcacactcactcctaaggaatgcagattaatagttgggattggccggatttcccttggtcacctgtcctaaccccttgcgcaaacacaggtctatatgtggaaaccctacaaatacctgcccatccctttttaacatttaaaatatttagttttaagaaggccacagccattgtcttttactaataaattgatgaatattatgctgcccaactttaaaaaatcatcacgatttgctaaattctgtatttagtgatgcaggataaccttttaaaattgtagataatctgcctgcaaaatatctggctagagatcaagtgtgaatcaaataaaatctatatcgagcacctactgggtgaaataaaagtactatgcttggaaactttaaagattatgaacaatttaaatgattaacaagcattaaagtaatacaggcctgtaaaaataactataatccaagctgttagcaaacctcaaaaagaacaggagtgctgtgggagtcaagggagaatacgactgctacagagaaggatctatgacgggtccatgcaggggctcaaatctgagtgtaatgctggaggataaagaggatttcaacagatggaggtttctggaaggacgttccgtccccagggaggaggatgaaaaggcacattggaggggcaagaggaagaggtacgcaacatgttttaggaatggtgtgctgtactcgatctaggaagtttaaagggaagtattgggaagagcttacagagtaggttaagatatggaaggcaaactacactaaggtgtgaggtctttattttcaggcaacaagctaccatagtacattaatgttagaagatcttattaatattaataagaccattatcacaatagtgtacctaggaaactaggcagatgagaacatagaaatggagaagtcagtttgaagccattacaattgttaagaagagaaataaatgaagcagtgactttgagggtttcaatgtgaatcaaaaggcaaacatagtacacaataactgtgggtaatggaaactacggcaaattagagatggccacagattcgggcattcctcccattgagagctggatctatgttctccacctggaatctgggttggctcagtgactgctctgctcgctctgctcattttaatacaacagaagtcatgttgtgctagtttccaagcccaggacctaaaagcctggcagttgctacatcctgtagcttagaacacattctttaagacactgagacactaggtcagaagtccaactaccctgagatggccatgctagagagaacacatttaggtgctatagttgatgggtcacacatgagcccaactctccagccatgagtaaagctgaaacccattgagtaatttcagtagatactatgagagcaaaagaatctctcagttgaaccctgcccagattcctgaccccacaaatgcaaaatgtaataaaagagtggttgttataatctgctacatttggggaacacagagcaaagagacacagatggacttaagatagataatgtaagtgacttcaaggatagtgatgccattcattttaataggataaacagcagatggattttgtttagatgagattagaatcattttgtgtgtgtgtgtgtgtgtgtgtgtgtgtgtgtgtgtgtgcgcgcgcgcgcacatcaagtttcagacacgtggccaggcatggtggctcatgcctgtaatcctagcactttgggaggctgaggcgggtggatcacctgaggtcaggagttcgagaccaacctgggaaatataatgagatttcgtctctacaaaaaataaaactaaaaattagccaggcatagttgtgtgtgtctgtagtcttagctacttgggtggctgaagcaggaggattgcattagtccagaagctcaagtctgcagacagctaagaatgtgccactggattcctgcctaggcaacagagcaagactttgtctctaaataataataataaataaatgaatacataaaagagagaggaactggaagaaaatccagagaaaactgaggggaaaagctattagggtcccaggaaagaaagtgaaagaaaggaaagaggccttctttaaaaaggagtgcttaccacctgaacaaatggtgagatttcaagataaataaaacatagatttgagggtgtatcaaatttcactgtctgtattttttgagtcaaacaaatggggaggaaggaaaagacatgataattgaaattttgaaattgaagagtagaaaaattaagggttaatttcatggaagttggctcaatatgaataaacctgaccagaaacctgaaggtccagctgagtttagagtctctcacccactcaatatttactgagtgacaactgcatactcagctctatgcatgtatgaatttgcaaaggaaccaagaagcatgaggtaaggcctattgcatcgataagcagcaaccatggagttgatataaggaagccaagtacagagtcaccaggaccaagaacttcagagcaggcagaaggttgaggtccttaagaatggaaggaattctacaacattcccattgaccaaaacattcaggttgggcagagaaacaggtaatggcactgcaaatcaagacaagggaagagtatagcttctataggaataagagatgctgagcatgaaggtggggatgggctagggaggaaaacagagagccagaggctcatctgtccgccagcccacaatccctgcccaagcacagagcactgtaatggacaatggatgagaaaatgctcattgtccctggattataacattaaaactatgagtttcacttttgaaaaggagttacagtgtgcaaaactggtgtctgctttagaactccagtccaaaggtaacaagatgaagtagcctatcttttctgagcttcctgatctgagacttaagatatgaaatgttatcaaatgatgtatttcaaaataaaatagcacttgttagaggtgctttagatgtgatttcattctgttaaaagcaaggaggtttggggcacccatatcagttcgggtaaattatcacagtcccacatcaaaacagatcagcaatgataaagataaaatgggaaggatgatgaagtggcaatcaatccttaatacatgctagctctgcagtaagcatggtgccaagcactcacacccatgcctggcacccaacagccacccagagccatatcaatgataagtccactgtcacagagcagcaagccatcatggagatgggttggagcactgccctgtcattatctccaagaatgagtgcaaatcaactagggactaagagcacattcttttcttacacatagtttttcaacgtgcacatctaagccaacatagattccccttctgctaccgatgaagggcatcatccagacctgcttgtgaccgcaactgtcctttatttacaatatgccctccactctgatcttaacagacttgatgttagaagccctaacatctttgccacctgaatgaaaggaagagaaaaataacccaagtgtctgaaatgctctttccttgggatttggaaagcgacaattagagaagaggggaaatgacacatatagagaatgagcagctaaaatggaacacgtagttcaagggtgatgagctgaaatgacatgtttgtcatgttaggaaagaacatttaatgagaacaggtaattttttgaggtttataattttcagactacaacatagtaccttttttcttaaactaaaggtactgtaaactgtcattacagtaaggtgacaggaaagggcattcatagtcttcatgcagagacgtgggcttttttaagcaacttaccatggaaggctaactccttgaagaggcttttactctaaatagactcagctctaaatagcaggtccctccttcccggactcagcaggtccatattccactgaatcatggagctcttgcctctcagtggtgtaggaggaacacattcataccagggcttttagtgctcacgctcagcactattgatattttagtcatataatcccgtgttctgggctattctatgaaattagcagcatccccggcctgtacctactagagctagtaacaccccctcccaccaccaactttgcaccaaccaaaattgtctctagacaatgtcaaattgcccctggttgagaacctctgctatagatagatagatagatagatagatagatagatagatagatacatagatagatagatagatagatagatagatagatagatagatagatacatagatagatagatagatagatagatagatagatagatagatatagatagatagatatagatagatagatagatagatagatagatagatagatagacagacagacagacagacagacagacagatgcatacatacatctgcatatgcatacatacatagataacttccctctttggaagttaaacaagctgccatgacttgaaagattattcaaaatatgcttatataaaacaccaaactaaatttgtgttgagtcattcaggcaaaatttcaagatatatgaaattcctgttaattataactatgtgctacatttgggaaatacattatgaaggaattttcaaaggatcaaagttctatcatcattcaaccaactctagaaaaataaaaatatattacgtgagttaatatgaaacaaatgaatttgccaatatgaagatttattctagaaagccaatttgggagacaacatataagcatttttggtgcgtctacttcaaaacccctgaaacccctaaacttccttttattttccagatgtaggaggatatctctataagctcgatctaaataagtacaactctgtatagaagtgtttgtgcaataaataacatttctcattcactcccacgctacaactgaaactgaataggctttggggacagaaaataactgctccttttaggaaaaaaaattgctgtcagataaaaaagaaatcaaaggaataaaagcttccatgaggcattttgcttagggaacagtgtctaaccagttattagtaaaaacagatccaacataagcttaatgtacttttcagaggaggctgggtttcttctgagctataggcctatcataaagatggatatagcctaatctgttggtatagtccagagagtccacaaacccctcctgcgcccatcccctacttgatggcattagagacttgctttggcaaaaggacaaaggagtcaggtgagtgagctgacctagtgaggtggcctcagagatgtctcaggaagtcctgtcccatgcatgccacagcaggacaatccttagtaccaaaaggctgaagcgattgctgcatgtgtgtctcttaattaggaacagttacagattgtcataatgtaaaaaaacaaaacatccaggatttgcaggagaaggagttggaaagcgcttttttttttttttttttttgagacagagtccagtctagttctgttgcccaagctggagtgcaacggcatgatctcggctcactgcaacctctgcctcccgggttcaagcaattctcctgcctcagcctcttgagtagctgggattacaggcacacaccaccacacctggctaatttttgtttttttagtagagacagggtttcaccatgttggtcaggctagtcttgaactcatgacctcgtgatctgcccacctcagcctcccaaagtgctgggattacaggcatgagccatcacgcccagctggaacgtgcttttcaaatgtttgtttttgcatttgttctttccatttcttagccctgttttaagggatcagatgaactgctcacacagaaactagagtcgccttccagactgaatgcagaaatactaaagaatcattccagcaaacaaaccaaccccgaagccatgccctacacaccctgacagagccaaagatggggtccagtgcatgattgtcagctgctgcccagtaaatagttctgcgtattgaaaaactcagtattcagcttctgcctttcaaaaaaaaatcatgcttttagaggaatagctgagaatgagctccttcttaatctgtctccactactcacactgcaagaccttccctgtggtccctctcaccttgccagggtcctcagaggcagccttgcacactcagtagtcacatctgcacccttgctgatgtcatgagcccctcatctgtctagtcctcccactgctcctggtgcagactgtcttccgtggtcacaccatggtggctgacaccagccacagcggcagctcctttccagaaacccagatgggacattagagtgcctgccacaccactgcttccacgtgaaaggttgccttggagagacccagaccttttgtttctaagtcttgattaagttttgcttctctcttttattgtaaacaatctacacatagtcccaatgccaagtgtatgtgctccaacatgctgaattggctgcctgaatgaacctgagaaaacagagctagtgtcctatggaccatttataatccacccatcccctgccactgagtgagcccattgtgaggtggcttaggcccttggtacatctgagacaagaaatgagtcaaggactcccagaatttggaaggtgaacgaggaaagataaatcatctagtctctcttccctctttgtagctgagaaggctatgggctcagagagattaaacagtgcatgtgagatcaaaggtgcagtgacaggccacatcaggatgggtcctgctaccttctggctgcttatattctacagcccaagctctctgctcaggcttctaaaaccacatacttatggccacaaggtcacatgacctgaatcacccccagaccaggagcatagccttgtctctagtgaatataatcagggatgaacctaaggcatgaaaacgggcagtgtcttcggggtatccttaatctgtattaaaccagccataatgaaggatttcttcggtggacaaggtacagctttccaagataggagcgaggatgaagaggacactagccccactactcccagatcacagctcagagtagtcaaacaaagaaaaagctctttttatatttatgaaatcgaagtaggaatagaagcaaagtcgtcagaaacaaagaaggaagaaatcctcctgaatgggggaatatagagactgtcatctttaaagaggttcaagtagagcgttcaatgaaacaggaataaacaatccaggagaatcaaagcccacggtgtgttcaggcctagaaggaatgtattaaatgaatctatgctcttttcttgctgttgtatcagatattctaggtacagtgtaggaaatggaattaaatgaagaatcaataaaacaataaacttaagttaatgcaatgttcaagtaaacagattcttctaatctttttcaaaaacgataactgaacattttattatttgggaaatacagtgaaattaaaggtttcttcttattacattgagcccataaggggaatcaggatgttccacaaatatatcacatctcttcaatttttatagtgcacttttaaagaaacaagatcttttttatattattttaacccacgtgtctcgattgccaagtttcagctgaaagaagtttgtcataaatgaattagggaaacatctttaggaatgtcttactgaaacacagaccactcttaactccagaaacactactcactgccaccttcaggtaactgaagaagttggctttgttacccacagattttcatcatatctgaactcagaggagatggaattttatggctatataaaaggacctcatgatataaaatggaaaaaagcaaacattaaactattttatacatttcaataatggttcggctccagtgaccttcttttatatctcccttcaaagggaattgttattatacttttgtcttcttccccttgtttagctccagatcgcctggaggaacgataaaaataaatgaagtccattagataaaattattatttacacaaaggcaatattaattttatctgtcagcaggttttaaaactaagtgaaagttcattcaatctacttctgtgtcagctaaagcaacaaaagtcctttctaagaaaaaaaaaaaaaagaaaaagaaaaaagtacttaaataatgggctttcaaggcaatgtaactaccttggcaatttctaaagaatttacctagagatgtttcctcagggcagaaaattcatgtggacacactaaaatattccagttataggccgcgcgtggtggctcacgcctgtaatccctgcactttgggaggccgaggtgggcggatcatgaggtcagaagatcaagaccatcctggctaacacagtgaaaccccatctctactaaaaatacaaaaaattagccgggcatggtagcgggcacctgcagtcccagctaccctggaggctgaggcaggagaatggcatgaacctgggaggcggagcttgcagtgagctgagatctcgccactgcactccagcctgggtgacacagcgagactccgtctcaaaaaaaaaaagaaagaaagaaagaaaaaaaagaagggagcaccattttctctttcgtccactgcaagatgtggagtctatgccaacacagaaaagcaatgctaccacagtgggaagaaaagacgatacccttctactgtcatcagtctggtcaacatcactgattacttcctgcttgtgaaatccaggaagcttatgtaactagatatctccatggcctttgtgaccactgacctttccttgaatatctcctgacatcctgtcttccctggattctgtaactccccaatctctctgtatttatttcacatctggcattctcctcgaatgaaagtacactccaacctcttctgaatgttcattgttttctccatctacacgttctcagaggcccttttcttcaaacccatgtgatttcacatggtctctaaaaactggtgactctcaaatctagatcctctccccaacctctgtatataatctagactcatacatcaaaataggggtatttacatataaaagccagtgtaactgctctaaagcaggcctcattatctgtcttcatcagctgtctcccttgcgtctgcttcctctcatagctaactacaccatcactcagacagccaactcagagctcaagggatacccaccattccctcctcctccatcttaccaaaactcactcctcattttgtgagtgtcttgacaatccttcccttacccacatttagaacccatgccctcctctggaatccatgccctcctctctgtcctgaccaacctcctgtatttcttacctctgcaatttcagccatttttgttgttgttgttgagtttccttgctgctaatcccaacccttaagcatcacttctatggagccttctatgaattttttcccacttttctctcgtccctatctggccccactgtacgttgattcttattcctgttacagcctttatcatcctgaactacaattacctgtgtatctgcctccttctaaaacaaggctgttaaaaactcagtctccagatagtactggacatagtgcagaaaaacaatcaacacctgagaagtggattgatggagaaaaagaatgcaaatccacatgtgcctctctaccttacctctgtacctctttacaatattagcacttccattaaaatgccatccaagttcccttttcttctatgactctgccattcgttgtcacagatgttttatccctcttttaaaattctcttaacatctggtccaaatataaagattcccatggttttgaaaaatgtcctttctaaatgtcataattgtccaattaatggtcaaagggatgaagggattactatagccagacagacttaaaaaaaggggggtcccctgggcctggaaacatgaaagcagacggaagatatcaccaaatgtatgaaccctgagggggtcagataagttattccagcacagataattcactggaaccacttgaaatgtcaaaggacaaaaaaggaggatattataattcacaccagaaagaaacttactgaattaataattttaggttaagaaatacaaataccttaaaatattatcagataaatttacagtaaatagactgctaataaacttagataaactatttagcagaaaggcttctgatctgatgttttcagattttagtcaggaataacacggtgtatatctgatgaaaccttttaaatccaatggattagacatgtcaatgccgatacctttgagttaattagagtttgtcacaatctttgatctcaaaaaaaaaaagtcagacctctagagcactaatcaccatttttggtgagtatattaaaaataaaaataagaaatccatcctaaaagaaaaaattaccaagacatatcatataaaaatcaaagatttcactaactagacaataaaaaagatgcaaaaaatccaaagtaggttatgtacactactcaaacatcttttacaggtttcctgaaatagacctataagataagtgttctcattcctttgccattttgcagatgtggagacaggactcaaggaggtcccatttccaaatggaagaagtaaaattttaacaggtaagtccctggccctaaaacccagggtcatcttgctgtcctctcacttctacaaagattgtctattgactaaggattaggagtcatgctagacacacaggtcatccagctgaagaaataagctgatgatttattcctactaactaacttcttgtcgggcctgaaaatgtgttttcttagagaggaaaatttcactaagtaactagctgcagcatcattcactgaccctgggaccagagacctcactgaccaggatttaatccagcaaatgacgcaatggctttgtccgtgtcatgtgccctcctgtccttgaggcaggggcagaggggcaggatgggctcattcagtcccatgacttaaataacatttatcggctggtgaatataagtgtacatatcaccttcaacctgtgcctgaaactgcaacttcatctgcctcttcatctctacctgagacaaagaattgcctcccaactaaccaggatcaagcaaaccactggtggtcccccttccccagtctacttcctggctgagtcttcgccatcacagctggagtcattttggattgctctaattcccccacacaacactctaaaccataagcaaatcccgtcactacttcctcaaaaaatgtataccgcacccctgtccccttctctcccatctgctactgcaatcccacctcaagcaccttcctctctcacctggatttagcagaagctattctaatgtgccttggtgtttttcattcatgcccctcaaaagtccattttctgtgttgcatccagataaatctttgtaaagagctcatctgattaagtaatttttccctgttcaaaaatttccaatagatctctttgcaacctccctaaaatgcaagatcctgaccccaccaacaaaccctcctccatggccacctccctatttctacatgatctccagccttcctgttccctgtgctcccgccacacacatgcacacacacatatgcacatgcacgcgtgtgcatggaactgctttctggtcttgaaacccaccaagctcatcaccttgcagatggcgcttgctggcccttagatcctagatctttttctacattctcccaaggtcccttctcactattcaggttttactaaaatgtcacctctacaggaaagcctccctggccaggcaggctaaagtacctcccttttactccactattagattccattattattttatcttcttcacatcacttaaaactacttaaaattgcttgactgatacatttttgagtttgggaatttttttacatcctattatatgaaattgatttaaaggatctataattttcacagcttctccttttaatgtgctgtatgtatatcaaaataacatgttgtacatcttaggtatatacaagtaaatacataaataaataaaaatatttcataagatacaggtatattcagtaccttcaaagaaggtaaattgagggggggaagcttcagtaatgggacagaataaaatatattggcgagctcaatgacagcaaaatagtttccagaggcctttgtcctcagtcatttcagtgatattggatatgtatgcttgtgtgggaggaataacaggacttagattatgatagtcagttgatgtccttgtgtgagtcctgtttaacacactggaatacaagtaactggaggacagattttattttgttctcttgctatccccagggcctaggacacagtatgacccatataaatattatcaactgattgactaggcagtggaaaggccagaaaccaagatagtcattttccaagtgatggataaactcactatgaaggccaagataccttctactaaataaaggcaatgaatcatccactttattttagccattgagcagtgcttacggcaagtttcaggagcactgctatggaaaagtacaagttagttcacagtcagcctattaggtgaaacttaggaatacaaagtcagtacagaattagcttcccctaaagcatctaatgattagcacatatgcgatgctataaaatctcacatgctgtgaacatacggtatctcatccttcagttcattagcctgaaatgtggagaggtcatggaggacattacaataaaggtctccatggtggaaaagtaacccccaagtgtgttcacttctgtatttcaaaatattaaaacctatgtgatgggaaatatgttaatgaaaatacaaaaatgatcccatcctaaatataaagccagaaaagtgaatgacagattgcatccatttggtaagtagctcctaaatactgaaggggttaaatactgttgctggatgcctgactgtctcctttttcagtccaaaagagtgagaaccatctacggtgttcctcagcctacaaagtaccagtgatccaccctgcctccaatgctagtttaggagaggcagccttgcatagatactaggagcacagactctggatccagatcacctgggttcaaatcttcgctccaccattaaccttatgcttcagttcccatgccctgtaatatggagataaaaaccatagcttaaaattatatgagttaatttgaaagaacttagaccacttactggcaattacgaagcactaaaaaattttgacaattataaacaaataaaggctatttaataaaaagaaaaatgctttataaatcttgtaggaaagacacgtctaacaaacaaattagtgtcttcctaaaaaaagacaataaaaccagttcagtgtttaataagaacagtgagaatgtgctgccttagccttaggaaaattcaacatctgcccaagaaatctataaaagaatgctcatagcagcattgttcataatagcaaaaaattagaaataatacaggtgtccattgagagaatgcaaatattcatggtctcttatatcacagtgaaaatggatggacaacagctatatgcaaagtaaatattagaaataagaacgttgagagaaaaaagaataatatagtaaatcaatatttaccgccaataaaaaaacaagcacaattaaacaatattttgaattcgataaaagtaaatgtgcaaggaaaagtaaaaggaagcttcacagtagtgctactgtgaatatgaataagtgtggtatgaacaacagaggtattccccaggatcaagcccccagtggaatgaggtcacccacagtccttcttaggccccacactttcccacttccacccttctgcctggaacacactcccccatgtccattttagaaccttatccattctctgaggtccaaatcaaacaccagctcccccaagagtggtaaccatttaccatgtgagaagcaaggaagcctccaggaagcgtgctcaggacacaccattgcctccatggccctcagcacgccctgccgtggagtctggcttcctgtgatgtgggatacggtgtccctgctgtacactaaagccacaagaccagagcctggcctgcttgttactgtggccactcactgcccaccaaagtttcttgcacgtagaaagtacctaatatttatggaatgaacataacaaccaaccgagcaataacaagtcatggaaagaagccccaggttgatctgggaggaggtgggggagcaggcaggttttggaagtgtgggaatcatgtcaacgaagtggaaataaagagaccacacttttggcagagaaatgaaataaagtctcaagatagaatgtaccaagaatggaggtagcaaatgcatttttgtttgaaaagaccaaagttataagtagtatggcacatccatactattaaatattatacagcttattaagccaatgtagtaaaactctatatactgagtttataaattcaataatgatgtgagtggaaaaaaataaagtgcagacatttatttatctatagattaaaaatagagaagaaaaactccaatgtttgactaaaataaactaatttttttaatgtttgtaagtgccaagaaaattgtggttactcctaagtcgtaggaaaatttttaaaaatataattctatattaaattttcaacaatatgcatttattaatttggtaatttaaaatgagcaaaatatttacatttaaaggaaggaggtaagattagttttatgggttaaccagtgagacaggacttcaatgcacatatttagatccagttcagggttgacttgccaggtataagacagcagaaaaccatggagggaaccattgctgcagtacggaaaagaaaaaactggttcaaagaatgggaggtgtgaagatataaaccttcataaagcagaggtcttctttccataagtgttctccaaactgaacgtgaaatctttgttattctcatgtaaagttgggccaaaaaaaagttatgttcagaatgtgtggcgtacaggtgtagcctgtaagtcaatgatagccattcctaaaactggaacctgctacctcttacttgctagactcagtttacctggagggaaaaaagtcacttgtacctaaggaaatgaaattggttttatcagctgcatcagataaactatgttatccaaagctttctgcttataccaagaagaaatgctcaggcacatagtcattgacactttccactgtgacttggccatactgcattttggtcctcaaagtggcccccgtagctaggtaaatagaacacacctgttaattcgttataggcaaagtagcacacatgtttttctctgtatgcaatagattacatttctggttgagtgagtagatgaaagtgatgtgccttctctaacatcatatgtaggaggaaaaatgttctgcttaatcttactgttcaagaaaatccctgcagttctctttgattatgaccacagtaacataagagacagttcattaaccacagagatgaaactggaggagatggggctgtgctttaaggaataaacacttcattctggaaggtcagatgtttcccaagcacaaatctcacagtttaaggatacttccttgcaggggcacacagacagatctatttagtttagtaactaataccgtgtatcacaataaatgacaggttgtggaaggaagctacccacacgagaagtctggaaaaaagttagtttacaacttgtaggatcaggcagtactttaatgactgtgagttttaaaacacaaacatgaggcagttggttggtatggctgcttaacagaacggtctcttttgatttaatgcgcgtgcgtgcacacacacacacacacacacacacacacacaaatacatcctaagagcttaacattatttatctactttgcctagttggtttcacctctaggacattctccaaaggaattcatcagatattttgtgctgggtatattttcttgatttctgtattcttgatcctctggcatttggagccttgtttctagagagactggccctcctagggctagcatattcgtaaagacagcaaacaacaccccagaggatacctctgcatacctaccaaccagccaagccagagcccccactctcaaccatctcctttatcaaattctcacccaatgtgctaatgttccccctacctaaagcaccccagagccaactaccacagcagtagggaacaccacatagcccagcacccaccaaaaatactcaaactctcaaatcctaaacttagtgtactcaccctgccttgcccactccttacagagagaaccccagtcaagcctctgcaagcctcggttttcttctgcctcccaaccctccctggtccttccccacgtggccctgtgtagcattatgagcctcctgtttacagagtctgtgagcataaaccttttcttcatgaccatcatgtctgcctctgctgtctcaccatccttgattaacacaaatcccacagacatttttaacatagatgtcagcaaagatttacactgaaatatattcaacctagtctgattattatgtgttacaagcatcgtttggaagcttctactgaggaagagggaaatagttctatacaaatggaacaaggaagacaaaaaaaaaaaataggaccaaagaagacaaaataaaatcaggaagacaagacattgcttttaagataaatatgctcaagttataatattaagtgtattggcaagaaactcaactctatgtacagcacataaacaaacacacacatagttgcacacccacatatacacatccacacagctgcacacataaatgagtgctcatgtgaatgcacacacaaaaacactttcatattgaaatataaacatacatttctataatttataaaaccagctgcacctatcagtgccaggttgcaaattccagctcagccacttcctggttgtgtgttctgtgcttccatcttcaagtggggataatactagcacctttctcatatggtttgtaaggatttaataatttaatcaacgtaaaacacttagaacagtgccaggtccactgcaagtactcaataatggttagacatgacaatgcaggtctttaaggttataatgaacatctggagaaaaacacacccaatcattagaacattctgagatatatggctttgcacatttttaatgctttggggcaattgtttttgcaagattaatgtaaattagcatgtatgattattataataaaaagtcatgtatccttttgctaagaagatgctgcagacaagaatcaagatgaattgggagcttaagcgctgtctctaattcacaccaccagaggattgcagtagctttactaataagtccagtccccataaatttgttatacatggtcatgcttgaagatggcatcaagaatgtggaagacagtgtcaaagacagcccttaattatttttaaaatgactagaattctcataccaaattctcaaatcaccatccaaacagcctcatcctaactccacaacaccatgttgatcacgattccctggagcttggcatgtgagtggtgctcttctgataggaagagctgatccacgctatcatcttcagagaaaaataaaatagagtgcaatgatatgcccaacttctctacaggaaatccaacatggccaagtattttttttccacagtagaaaacttgaatttaaattagattttttacataagcagcacaatgaccaaagaccactgactgagatgaaaacagaaaaacacacgtcaaggaaaacactatgatatccagaagcctagaaaaaatatgacactggtgtggcatcaaattccagatcaaattaagtgcactggtggcaagcatccataacttcctaaatggaagtcggagctaaagtgttcaaaaacaccagagctggcatcttcatttatcttgagagtttcccccacatatcgtactgaagataaaatacaatgagatcataacccttcaaaagcgtagcttattgtgcaatatttttctccagtggttaatggtgattctcacagattggaacagaaaaggttatagcaagggccaggtctgcaaacacattgagaaaataatttcctaacagacaagagcctcagtagagtagaaaagacaccagcatggctgaggatactgaagaactgcaattcaggtagatcaggtaccaagcccttctgcccttcagatgaaaagtctcttccatttaccaaatttgcccacaaaaatatttcaattttctgtgtctaatgtcatgaaaaactttggaaaaaactatgagagtttgagaaacacaggcctaggtttaatctggaaaataaagtatgattcggcaaagtgaaccttctagcaccaggttatcagcaatctagaaagtggctgtgccaggacttgaattcacatgtgtctgaatcggaaaccactgtgcaagcctgtgctaccaatggtataaagactgactgttttgagtatcctgataatttgcaaaaatattgtaccatcatcatcaaagaaaacgccacattttttaactttgaaaaatgtgtgcttcatttcaaatgtaagatagtgctaagatagttacctctctataaaaaatgaatttcaataacccagcaatcccactcctatgtctatatctaagagaaagaaaatatctgttcacataaaacttgtacatgaacattcatagcagcactattgataatagtctaaaaagtagaaatgatctgaatgtccatcaactaatacatggagaacagatgaagaaaatgtggtagatgctacaatgaagtgttattcagccagtaaaaggaataaagtgctgacatatgctataatgtggatgctataacatgctataagccttgaaaacatgataagtgaaagaaatcaggcacaataggccacacattttacgattccatgtatataaaatatctagaatatgcaaatccgtagagacagaatatagattagtgattgccaggggttgatggaaggaagaatggagagtttctgctaatggatacgggtgttctttctggggtcatcagaatgttctaaatttagataacagtggtggttacacagctctgtgaatgtatgaaaaattatgaaaaatctcaaaagggtaaattttatgatatgtgatttatatcttatgtaaagctgttattaaaaaataatttccaactagcaaccaggctaccaggttcttgtgatgatggttccagcagaagctggtgatagagaaagaagattagggtgtggctgatgacggaaaggggccttgaggggaacttctcagtcttgggtaagaggggcttccacagtggtgtttggtgatagcggtgactatgggagtcacaaaagtaaaggagagagctctttatataggaagctttccatagtctaggttcccattagcttgacatagatggtgaagggggataagatactggtatacatacaaagtaaaagagccatatacaccgtggaatactatgcagccataaaaaaggatgacttcatatcctttgcaggaacatctatgaagctgtgaaccatcattctcagcaaactaacacaggaacagaaaaccaaacaccacatgttctcactcataagtgggagttgaacaatgagaacacatggacacagcgaggggaacatcacacaccagggcctgtcgcagggttggaggcgaagtgagggagagcattaagacaaatacctaatgcatgtagggcttaaaacctagatgatgggttgataggtgcagcaaaccaccacagcatatgtatacctatgtaacaagcctgcacgttctgcacatgtatcccagaacttaaagtaaaatttaaaaaataaaagaattaaactcagataacttaaaaaataaaaattaaaaataaattctttttatcattttcaattcagaataatttgatcaatttagacaaattaaacaatctgaagatctaaaaaaaaatgtaaaattgacattcttcttcaatagtttgaacacaatgtacatttttttttttttttttttttttgagacggagtctcgctctgtcgcccaggctggagtgcagtggcgggatctcggctcactgcaagctccgcctcccgggttcacgccattctcccgcctcagcctcccaagtagctgggactacaggcgcccgccactacgcccggctaattttttgtatttttagtagagacggggtttcaccattttagccgggatggtctcgatctcctgacctcgtgatccgcccgcctcggcctcccaaaacattttttactgaaatgcaccagctctccagatagctcattgccctgttaatattcatgaagaaatcaactctacaattactttaaatacgttacattatatacaattataatttattataatttacattacctagaattataaattacttcatgatttatatgacttatttccatgatttatttaatgcttgtgttggtggagaccagtgtctgacctcaggaactcactctcctctccaaaatgcatgcttttgtgtacccttagacaaccctgagagactaggtacacatttcttcactccaacttgtttattaaaaatttccattcttttcccagaattttttttccactgttcaagcaattaaggcaaatagctaaagaaaactttttcagtactggtcattcccaaagagaagagcaagctggaagacccagtgagcatgaaggtggatgagcagtatccataaaagtcgcgccacactgcctggacctatttcttccactatgtatcacaagtgcttgcatattttactgtacagtgtgttaagtttcagtgaagacaaagggtctagtgccatatgtcagccaaagacaatgtttcccatggtgtccacccttaattattaaacatgtccttctagaatctcagaactatcccaaaggccatatgtgccacctcgtaatgtgaggcctcaatcttatgacacctgtgcaattacaatgactcagcatccccgtgtggtcctcttctcagctcctaaaagaatcaccctcattccaccattgccaaagcacaggaatataatgtgggacgtgctgtcaaaacaggatttcagatcacaaaatagttatgttccccaaaatcacagttctataaatcgttagcaagcatctttccataaattaatgccttgaccactaggcaagactctcatcctatggggattttctgggcaatgtttttgtcctataggagttttccttaaaaaatttaaagatgagaatcagcctggggttgctagttaagctcaacacagtcctaataagcagctgcttctgctcccaactgtcaccattccctccatatcaatatctctgagaaggtcagcacactgtcttcagcatgctctaataaatcaaacacaagtttgtaccagtcgaataaggccccgtgtatgtgttgctacacacttgtctccactggtctacaacatagaaaattgtgtccttatttgctgtaaccacatgttcactacaattaactctatacatgtacacactacatgctggactcagatgtctaaaccatacttctttggcccatctatctctcttaatgtcaatctataaaggaggatccacagaacattcatgtaattactacaattaacaaggagatgcaagtcacggccagggactagtaagttctgctataaacacacaatcacagagcaataaaggattttggcagcttatctgctctttcatcacctctctggctcttgcaaaagtggagtgtctcaacctcaccaccaatttcacaagagatgctatgactttatctatgattcctccatgcaaatgtgactattctataggccctttgagctctttctggaatcacacagatgtgagtttgaaatatgccccactttccagctttgtgactttgaaagagttactaatcttcggtaattctcttttttcttcttctaagaagtaccatctacctgtcaaggttttggggttttgagtgttagtgaggtgaaatgatctactggtaccatctacctgtcaaggttttggggttttgaatgttagtgaggtgaaatgatctactggtaccatctactcatcaaggttttggggttttgaatgttagtgaggtgaaataatctactggtaccgtctacttgtcaagggtttgaagacccaataatctcatcctgcttttaatgttcccaatacaccatcagaactgtattaagggtccacaagatgttatctgttgaatgcccttctcaccttgccccagccagtatcctggttgaatcattcctggctctgttctcctttttctctcatgtatcctcaacatggcttaaacccatctatcaggaacttctggacttggtcttatgacagcccctgaacatggccagcaagatgcaacacaaactcactccaaattcctcttcctgcctcatggtcctctttgcaccaacaattcagcacccttgacaccagcattttcatgcctacatgccccttgctctttatgctccaaatgccatctccaaactacaattttctatcttctcccattttatgaagatccactacaaatgcatccacaaaagctgtgttaattaccctctgtcatggcccattcgaatgaattattccttccaatttgcattcaaactcattgtatataccccttattatttcacttacaaagtgatataactgtttatgaatttaactccccaatacaaaccagaccgtaagcaaagacactcttttagtacagtacacatttttatcacaatcgagcttaggtctgaaacattgcagagacacaggcaatgtttgtaagacaaatgaggaagcacaaggaaagattaggaagcccagctcctccactaggcacccgagtttaagtctctgtactgccccttgctggctgggtgactttgggcgagttatttcacctcactaacattcagctgctcgttacaacactagcatattaattgtactttccttgtgggttgctataaggattgtaatattgaataccctccatgcatcatctcacactgactagcatacaatgattaacacatacctgctgccacattataatgaaaattggaacccccaattttaagccatctcatgctctgctgaaaaatgagccaatcctctttgctgaatgctccttgacagtccacagaggcttaaggcttagaagcaaagaacttattaaaataggagggaacgagagaaaagggaaacagtaactgttcacagacagctctcctcttctgccactacagccagtcagaaacatggcaaaggtctggatatagagtgtttacatccaagttctaagcctcacccagcctcctactgtgaatcagtttgtttgtttgtttgtctgtttgtttgttttttgagatgaagtctcgctctgttgcccaggctggagtacagtggcatgatcttggctcactgcaaactctgcctccccagttcaagcaattctcccgcctcagtctccccagtagcggggattacagatgcatgccaccatgccaggctaattttgtatttttagtagagatgcggtttcaccatgttggctaggctggtcttgaactcctgacctcaggtgatctgcctacctcagcctctcaaagtgctgggattacaggcgtgagccaccatgcctggcctgtgaataggttttaaaagaattacatatgatttctctgttcattttcccacctatgaaatctacagctgtcatatttcccagaaccatggtgatacgcgttttcattagctgcctgccatgaagttagattaagaagacatcaatgattttttctaatcaaagtcataaagtcaagtggtttcaaataacaacctccactatatatatgttaaagagaaaaatagcacccatatcgcagcctgggtgcccataatcttctaataccagtaataaatctttctgcgaaggctaaatcatttataaacttgttaacacagctcaagtctctaatgctgtatcactaggtttcttacttaatcaaattgtttaaaaatgtgtatttgcaatactgagtgattaggaggtttatcttatgaaagaccattccagtgtcccgttgtacacaaataatttgaaggcaatttccccttgttaagggtaaaaactctgattagactaacttctgatagctagttattgagatcacagaaagaatgcagccactagtgaataaacaaatactaagaccttccaggtggactgtctcaggtgacctccaaaggttaattcatgtaaaaaggatactgccattacaaccagaaaccaacaagttatgccctccttttgaaaagtattagattccaggatggattatccagccaaccaaagaaagggcgaatataaggtaaccagctctccagagtatgttctctcacccagtttaatgggaagctatgtggtttggaagcaaattctagagttacagaatgttaagcaagatattcattattttaccccatcatgaaacaacaagcccaaacagctaactccaggaacgttttctgagaccgtgtgcacatcaagaaacaagaaacaaaataggttgttgaaaacacccacatgttacagcatttctgcccttcctgaggatgggaataacattagaaataacttcacagaaaaacagactccccagagattcaaaattccccaggaatctcaccatttggacagacatatgtactctggaaaaattgttcctatcatccagtagccatgaattctaacttagtctaaactttccattcaaaaggcagcacctttcttaattttaagcaatgtctaaagtccaaagccccaggacaacatttcttctgagcctgtgtcagcttcattcagtctcattgaactgaatgatgtataatcaaagccaatgggattctgaaggagagagaaagtgagaatactagactcaaacctgaacagagctgagtcaattacagaaaagtcttggcaaagtaacttcagccccatgaggtgctgtttctctgtgggtaaataaggatactcacagccccctgtctcttggggcatttgcaaggagtgaatgagctaatacgtacaaaaggtggccagaatgctgggtgcacagctaatggccaataatcatgaattaatctccatgcccttttaaatggagggacttcgaatatgctggattctcttccatatcacttattactccatcattgaattggccatatagaaggcatatgcaggtaaacgatgtctgtaacagaggtcaccaactcatccacggtgagcagatgcagacaggtgcatcatataaggtcacaagtggccagcaaagaaaaggactcacaggccagcagaaacaacaagatgatgaatatctgggacctgtctttacccaacaggaataaaagaaacttgggtttccaatttaccatgaatgatgatggtactacaggtcttctgccttacgtagtcagagaagtagacatggaggaagaatttgttagaagcaaaataaagcgaacatggttaaaatgacaacaacaaactagctctgtctcagaggactccgcatgcacaagagcagtatttgtccaaacacaaacattttcccagtggcaatgacttacttactgctaagtccagcagaggcagcgatactaatttataatgtgtgaaataaagaaaagataacacaggcttctaaaaggctggccagtgggaatagtcacataaagatcccagcctagatttattaaaaattacaataattagtcctagaaaagtagaaaactagaattattttctcaaacataaaacaaactgccctcatgtcagtactcaattccagtgagaattgaataaatttctgctttgggaaaaaaccagcaacactgattttatctttaataaaaggagttataaatatcaagaaaatattttgatttgtataaatgcatcaaatataaaatttaagccttaaatatttattggatatgtcaagtatggatggcactggacattttaaaaattattcaaagaaattttaacaggtattaagtaactcaaatccaaattagaaaagaagaaacatatataggttaatgtataataactgataaaatatcagatttaaaatcataaaacatctgtaagtttaacacaaatgtgaaatgtttacgtgaagagaatgtacggaaatgatattaaatgaaattagcccaatgcaagtaggtgtcctgtagtagatagatttcaaacaggtctttcagtaaaagttagacagttattaccatggaatttggaaaatggaaaattaagagattctagaatgaggaaggtactgtatcaaatttctcagagaataaacactattccagagttccttagcttcagcgtgactgtcattttggacaggatacatgtttattgtggatctgtcctgtgcattgaaggatgcttagcggtattgcctgctgcttttcatgagatgtctgtagcacaagaaacagtcttgacaatcttagtgatgtttctaaatattgacaaatgtccccttgcagaggaggagaaggcagaattgctctcccttccattgaggaccactgctgtatacaaagatacaatctacaaaaagagtatgtaacaagtagactaaacataaagagagaatatcgtgattttattttccatattttgattttcttctctacttactgtgctaatacgatcttacagaaagtgctacgcatagtaatcaaaactgtatcctgaattagtacaacacaatttcagcacaatgaaacatgggtttcaaaaatcagttatataatggataccagaaaaacaggcttctgttaccacagtaataaggacagcacagtttggtaaatgaagtgaacattgaaatttagccctcatttaacacatttctaaaacttaagcaggaaccacaaacctccaagggaagtgtattttggtcccataagctacctggctgcatttgctttgctttgctaatgacaacagaattaccagccaagtgttcacctgtggaagaggggctataccttcacagggatcagcaataaagaataaaatcttcctcagtccccagctaccctccccatctcttaccctcatgctgctaggtcaactaagccattccttatcagttgatgcagtggcctgccagattcctttaagctctggatggtgagtacctagcgcaaaagtcactttaggaaaaagaagagtctgtagtcctgccttaccaccatcaccatcaccatcatcaccatctctaccaccatcaccaccaataccactaccatgaccaccatcatcattgtcaacaccaccactatgacttttaccactattgccaccatcactactactgccatcatcaccatcactaccaacaccacaactaccaccatcattaccatcactatgaccatcaccactaccaccacaccacaccacaatcactaccacaatcatcaccaacactaccatcaccaccaccattttcaccaccatcttcaacatcattatcaccaccaccaccaccacaatcaccaacaccactgttaccaccaccaccatcaccaccaccaccactacagctagctagaagtctcactctccacagcacggaatactataaccctgcattgggctccagcacaatcaaacttctccttgaacataatccactaaggcactccagctcacacttcttaactccactagacttttctacttcctgcacttttacaattccagaactttctgaagtcattatcttgatctgggatgtcctctccacacaaattcttaggttaccaacttattaagtcaaacttgaagcacagtggatatgcagtaaatactgaattgctcacaaattacagaaattccctccatgatatgaaacaagctttccagtggattggcatctattgatttaactcctacatcgtgcttagtaggtgcaggcatggtactaagtattttatattatcagttgatttatcctcataacagcacaacacaacggttactattattatcctcatttttcatatgaagaaactgaggcaaagggacatcaagaaaggtgcacaagttcacagaactaaaatttgaatccaggcagcagtctcaccatgatctctgaaccactccaatgtgtagctactctacactgaaaacaatttcaaaacaaatttttagttattttttttttaaatgtcatagagtctaagagatagccagagatttttctaacaacagaatcctatttttaagagcctcaagcccagcctccctctcctctgagagcacgttgaagaaaatttgggcccattttaaacacagtttagacatcactgtttttacggcaaatatttgtttttcacagacatggaaactaagacctgagaaagggtagtcgtttacccaagtaacactgaattagttggcagcagagttgaaactaaaaccctggagtcccgatgccaactggatgattttcaattatcccttggccccctggctaatcattaaatagattttctacagaaaggtgcagtttcatatctaccaggtaagaaacatggttgatgacacatgaaaatgattcactagaaaagacaaaagataatcattcacccaaacacgcctcttgctaaatcttcagagtctaatatcgcacagtgcaatttgggattcaggctttacctctcatctaaggagtccaaagcccttctcaggcaaccctgggccactaagttactggccagttagcaacagagaaaccatgtaacaaaaattgtactcatctggtaggctgagttcatggccaagccagaaccaaaactccacctctctctgtacatccacctgtgatctggtgcatgcccccagccctgggctccccctcccgacccacacctgtgaggggacctttacctgcgtgtgctggaggctcctcagctgtttctccttctctgtaactgatttactggctgaccttcagaccatcttaagcctttccatgactaagtttctcctgtgcaaaattacacttctctctctgaggaggtgttgagaatgattaaatgaacctggccacagagcgagagctcgtcagacacgaggcattagatcggggggctgtgttgtccgcggggtgctttctggtgatcattcatgcagatacccaaatcaaagtctccaggtaaagaaaacgactttggaaaactctgtggttttaacaaacacataacaatgcccccacccccaccgttctctggtttcatattaagtaaatcttttactgagggttttttctatccaggcacaatggaaccctgataaaaaattttatgtatcttctatgaaaatacctataaaaataatttgatgggaaaaaatctcttttagcttctgttttaccatgagaatttctttttttagagacaattaaaagttaacacaaaagttttatttctcagtacctgtaatttgtttttattaaattaaagaaagagtatacataacagataagcattcacctatacctataataactgggaaaaaaatcatatgatcatgtaggtctattaagaaagtaaaaattaaatataacaatgcactccagaaatggatactaagatcttatttaaaatacagtatgtatgactaataaattgtcattctcattaccatgctccaaatagttatttcctttcttaattcaccttttgaaagcattttgttccattttcctggggctgttttactgcgtgacttccctgggcattcaacagtcaatctccgcaggattgggattttcatttcacgtgtctttaatctagcaaagcattcaggctactcttttcacagatataaataagtaaatacaacaatcttcaggtaaagaaaaaatacattcctcagggacaaggataaagctggaagccatcttcctcagcaaacaaacacaggaacagaaaaccaaacactgcatgttctcacttataagtggtagttgaacattgagaacacgtggacacagagaggcgagcatcacacacctgggccttttaggaggtgggggtgaggggaggaatcttagagagcgggtcaataggtgcagcaaaacaccatggcccacgtatatctgtgcaacaaacctgcacattctgaatatgtaccccactttttttagaagaaatgaaaaacaaaaaaaaattttaaagaataaaagcaggaaaaaaaaaaaagacattcaagccgcctacatttccataacagagcgttctctatctacttactatatttattcttgagttatagcaaatgacaatttccatctggacttttttttttttttaaataaaggcatttctcatttcatcttgtgataatttgaaaaactatgtatactgtgtaacctaaataaaatagattatagcaccactccaaaaattgctgtcaacttccacacatactaagctagtggacctaccccaggcaaaagaaacagggtcagatgctgcctaatagaaatcaagtgacacgtctttagcatgttctttgctatgccactggttatctgtagaggctccagagtttagtaagtcttcttaattggacatcatttagctcagccactgggctcaagtagacaaataggaagtgagttttccatgtgtactctgttccttatctgcacagtgggtgccctctgaactgagcctcatcagaggctatgtgtctcagcccacacgcaagcaacgtgcatgctgcctgaagtggaagcaaaagtgtgttgttagttgcgcacccatagaagcacacctgagcctccctatacagtgcccaactagaagaggctgagcacttccctcctgtcatttgtagactgatagtccagtcccatcattaccaggtctcacccactgccagaaggatggctcgtcctcagtcccatgaactcagctgtgctcatgagttaccaatgaggaagggatgaaaggagaaaataaaaattaatcttggccgggcgcggtggctcacgcctgtaatcccagcactttgggaggccgaggcgggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaattaatcttgtatccacaaaacataaaaactcacattaagtatcccatcatgattataaaatatcaccactcatcacctataggaggataaactaaggctagttaagggtaaatgatattgtgactgtcaggactagggcatttgtttagaatgacatagaaggtcttagctaaatccatgcaaagtgttccccgaaatgaacgttcagtctcctccaggaaggtgattccccgtctcagtaaaacataggtagaaaaatcagtcttatcatgggttacagaataccctttcctttctacctcccccttctgcttgtcctaattaagtcctcgaaaattaattgtataaaaacaaaatgtagtctaccacttattagattatcctatacccaatagactatgcatgaagatctttggaatgatttccttgattgacctacaatattctttaaactctcagatcaggactgtatataaagtaaattataaactgttttattgttattcctctactacttcattgctttttttttttttttttcacatggaacagtcccccttgttattacaggctaagaatctcttatctgaaatgcttggggccagaacggattcagattttgcattttttttttttttttttggattttgggatattggcatatacataacaagttatcgtggggatagaacccaagtctaatcttgaaatctctttatgtttaaatacaccttatacgcatagcctgaaggtgatttatacaatatgtttaataattttatgcatgaaacaatgttttgacagcattttgactacaatccatcaaatgagatcaggtgtagaattttccacctgtggtatcatcttggcactcgaaaatgttttagattttggatcactttggactttagttttttagattagagatgctcatcctgcattttcttgtataaagatacttcattaccatggcaaagcattcctgtaccatccattaacaatctctggtgtttcgttcataatgtgtaccattccatatttcccatccagtgaaatgtatgcataacaagtattggcaggagacaaaacaaaatccttactcctagctatgggtacaaagtcaggtggccaggcattgggctcctagcagtcaagagtgaaggagacattggggaaggtgggcaggtcctcaggaaaactggaaataaaattatccagtgacaggacagtggccaaaaacatttctcaaattgtcatgggaatggtttacaggagaatgggcgttacttaaacacaggccacttatgacagcaaacgtaaccatctacactagatatatatggcattaatcagaaataaagatgttagaaggagaagaatcagaaataacacacctggattctgagcctttggaaagattttgaaagtttaggcaaagagcatccaaggcttcaatggcatgtacagagtattgagcaagatggagctaggagtcacataaacgggctgttatacactggcatattgggcaaagccttctggtatattccagcaagacttcataacgaaagaccttacgccttaaaatagtattaattgaaaagaatgataaggcctgctgggggctaaaagggcgtagaagaagacagatttagaagagagggtaagaatgaatgcttgaaatcattgcataaattaataagtttctgtgtatgtttaccctgttgagtatccacagttacaggatagggaagacaagtggtagcagatattatgtgacaatgtttttgttatacatagacaacaaaagctccatatgctcaacaaaagtcagattacagagccataataatgtacatgtttctgaaacattcctgtattttgagtttccctcaaagcctagcatttataaagtttatcgctggtcctttcaatgaatttcactgaacacaagccaggcatgtatcaaaataggtatataaaatctctataaagtaaataaaactcatcagagaagctggaacagaacatttcctaactttttttcaatctgggaggatctgattcataattatcatctactgtctttcttgactaacaagtgagagccaaaaggatacccaacccttttgtcttggtgaaatgaaaatctattatgtaattattttacaaataacacatataacatgtataaacagacgttattataatcatcatatttcattttaatatttgaggctttaaaggataccattaaacaacattaatttcatttacaataaatgaagcataagacatggaaaactacttggctgcatttaagatctagcgattcaactataaggaaaaattactttcatcgaagatgacagttttcctctagctcttcctactgatgcctatgcaatacagtctcactaaatgagcataaaataaaaagatgtccatttgatctttggacaaagatcagatttgatgacacagatctacatccagtggtctgattatggatcctgcataaatagatggaaataggttcactttcaaacgtttaggcatcattggcaagactgacgcttctgctttctaccagtcataatatgaaaacattggcaatgacctttactagaaatcttcatgcaaatgcaacaagaaactcacccaaaacattagcagaacctaccagatctattcattagaagaaaatatcaaccataggtatcattcacaagtaagagaagaaaagcattagtcattttacctagtatcacaccatgggcttttgagttggcaaaaatgggaatgaatcccagcttcatgactctaccctgggaaagtgacatatttctgtgtctcagctttatctgttaaatgggaccaagagcccgttaccttgtagggttcacaagatgactgattgaaacaacatatgtaaaacacctaggacagtgcctgcatatagcatgtccgctataaatatcactccctttcataggcgactgctctaaaaatattatgtcatttcatagatgggtctcaattattttgtgattcattgcctcccaaagatcaatctacttgacacaaaggaaagatctagtcaccatgagacagaatggatattgaagcatacagacatttgactcaaattaatcaaaaagttgcatttttcagtaagtcagctattaccaagtgcttcttatgaatagttattttaagatgcagctttccagaaatactgctttcttaaacaaagtttcattccagaaaggaaaaagcctttggccaatttagaagaagctttgtaccattcctgggaactgctcagcatctggggttgctggattttaagatggagttctcctatctaataaagctgctatgatcattgaacacagacacatgtaagatgtgttggggccttggggacgtaaaatgatagcacgaggagggacaggaatctaaatgctttgtcgcacacaccagagcataaataattatcaaagaatgcttaggggaatttaatttaattctgcatgtaatgaaagatgaaaaattatcttttccattaacatcaattgcatcaaaatcagtatttttataattttctcaacctattttttttctttcaactggcgaagtatcaaaaggcaataaagagaaaaaaagtacttccagatggttggtctaagcaaattacatgcaattttcctttaaataaaatggaaaatatatgtaatagaagccctgctgaacacctatcaaatcaaaatgattactgtctgcaccgttgtaattcactcactggtttatggcctcactctatttcaaagagtttcccaaattcatataatgttctgcagtgctagagctggcatcagatctctgatgtagctgaaagatgcagactgtgaaatcttccattgttggacaactttcttatttgggacatagttgagaaagctgagcagccaaaaaataaaataaaataaattgtcctttcaaaggcagctttaaagtcgcactcactcagctcaataaactctgtgtttcaggggtaaccacaaaaagagaagactttctacttgttgttccaagtatacattttacactaaaccctatgctatttagagagatattggtaaaaaattatggcagtgggtcatcagatgaggaattccctctcaaaacccttctagataaactgactctcaattcccccaacctttactcaagaaattggattttatgtgctccatccttttaccctaaaactcattagtacataaatgaggagaaaaagttgagaattggagaggtgggaggtcagggaagatagagggtcactgggggagtggactgtccactctaacccgtttctgatcactggtatccacagaatgaaccccaaagccatcgcccatcaaagggcaggtcccacacttcccagcaattagatccaggtggaggtgagcctctggtggggtggtgcggaagggcagagccaggtaaccagggtagtcagggcatgcctacctcgcccctaccccagagcctctcacctgcaaactgggtacaagcagttggtgtaaggtcaggaatgttgtcaaaggcaacatgaaagttatagtgtatcaagttcaagacctggacttcacagatttatggctacataaatacacacaatgtctttatgaatttgcccctgcttttaatttagtaagagaccttcaaagcaggagttcaaaaccaggggcaattttacttcccctcctcaggaacatttggcaatacctggggacaattctggttaccacagtgaggggatactacgggtatctgtcaatagaggccagtgatgctgataaatttcctataatgtgctaccctcactgacaagaagggattatccggtgcaaattgtcaatagtgccaaggttgaaaaactctgctttacactgaaaaaaagagagatggaatttaggtagcattatgttctgtaagtagaaaagaaattggtaagaccagaatctcttaccactgaaatgtttctcagctgctaaaatagggagcctggtacactcattgaacagctttctaattttcttttatatcctacacagattttctctttattctgccatgcagaaaaataagagaggccatttatagcaaccatttgaattctctcctgtattattttaagatgctgctgcttttacattttgcccataagaagttttactagaataaataaaaccagttgtacacaattcacagacaattgttttccaaaggatttttttagtattataagctgtaacctctaattaaatatgtgatcccactggattttatacatagaatatagttaccatatttacgtgtgcacattatccactttactaacttttctaaaatttctcacataaatctgaatttttaagccttaagtgggatcccaatttgtacatttttctttcaactatccatatcttttgatagtgaatagaccagtcctcagttactccttagcacctcctatatttgcaatgcaggacccagtgattacttctattacttctggtagttctcaaagttacaaggaacaagaatgatcatgaaggttcaattcacctgattccataatcacattctttgctcttgagacattcgccccgttacttctgtgccttgtctttatcaccacaaatcctccgatcagcacatcccttgcctatcagcctctctacttaacaacttcatttttacatttattacatctttcctgccagagtcagtttggactactataataaattaccatacaccaagtggcttgaacaagagaaatgtatttccctctgtttagaaggctggaaagctcaagatcacagtgccagcagatgccatgtctgagggagctcctttcctggtttggaggtggtgtcaccttttgtatcctcacatggcagagcagagcacaggagcaagttctccagtgtctcttctttttttttttttttcgagatggagtctcgctctgtcgcccaggctggattgcagtggcgtgatctcggctcactgcaacctccgcctcccgggttcacgccattctcctgcctcagcctcccgagtagctgggactacaggtgcccgctaccatgcccggctaattttttgtatttttagtagagatggggtttcaccgtgttagccaagatggtctcgatctcctgacctcgtgatccacccgccttggcctcccaaagtgctgggattacaggcatgagccactgtgcctggcccagtgtctcttcttataaaagcactgatcccatcatgagtgctccactcttacaacctaatcacctctcaaaggtccaccttataatactatcaaactgggtgttaggatttcaacatatgcattttgaggggacacaaacattcagtccataacacttcctatatgcaaagcagagcaaaataaaggcaaatactacattttcaaagttatttgcctcagtagcatcagcatttggttccagctgtaatcctcagccccctcccatgatggtaatcaaaggcttgccatttgctggaaattcctgccctgcaataggagtgttcttcaccctctacatctgacaactgccctccacagttcacaaatactgacggcgcactaaaccataagctctttaggaacaggaactctgacatatatgtatttataccccggagagtaatcaaattgtactacatatactcctggtgctgatgaggaccagtaatgagacagatagaatgtatccagagacatctgttggtgctaagaagggctcaggcaggtaataggcatcctaaccatttaggacaaagtaaaggacaaataaatctccaattttagtcatttattttcttccgctagctttcaggttgatgtgttctttcctagttcctttaggtacaaagttagattgttaatttgaaacctttctaaacctttctaacttcttgatgaaagtgtcttggggctacatgctttcctcttaacactgctttggctgcatcccagagattttggtaagttgtgtcctcgtattcattgatttcaagcattttttttttatttctgccttaatttctgtgttcacctaggagttattcaggagtaagttgttcaatttccatgtgtttgtatagttttgagagatcttggcattaatttctatttttattgcactgtggtgtgagagtgtccttggtatgatttccaggtttttgaatttattgaggcttgctttgtgaccaagcatgtggtcgatcttagaagacagtctgtgtgcagatgagaaaaatgtatattctgcggttgttgggtggagtgttctgtagatgtctatagaaaatgttttggccagagtgtgtgcctcacttagaaaggaaggggaaagatagaggaagggcagtgcaaagtcatgttcaatggtcatggtcagtgaggcaaaactgcatctctgagctcaggatgaaagaggatgaggcaacgatggtcgaggatgctgattacatctcctaagtacaggttttaaacatgcacacatctggtcaacctcttctgattgtgtgcaaacctaaggagtcacaggtgggccctgataaggtcatgagataaaatagggggctttatgtttcctagggcatgcatgcacacacaagtacatggcagatttaacattttataaatgacacccaaataactcctgtttatcatctgggagcattccatttttttctcaagaatcattgtatgacaagatatggcaaagctcaaattaaatcaacacaacgaataaccaacaaaaacaagtgaagtttcagaagggcaaattaagaacaacttttgtttttctgtggtgtcacacagagaaaagttatgtctagagtagatactctttgatgtacatcccaaaagctctattagcacatctgcagccaaaccactggtttcaggatgtgtactgttgggcccctcggtggccatattggttccagatggagttcaaataacataagggcctttgttcccgggctgaactatttcatttctccactggtaacttgcacacatgatggagcgctccatcatgaacgatgtgcaatgcccaggggtgcttcaaaaaatgtaccacagagactgctaaaactcatggaagcccctgcttttaagtgatagcagcagcatttgccaacagagtggtgctagtgggctgtattacattccatctttgtttatgcaacacccctggaataaaaagttaggcatttaccattataatttaccttaattatagtatttgtcactacctgtaatgcacaaaagaattatggtagttgcactcatagaagaggaaaatgagacacagggagcctttttgacttgcacagggttactcctatgctggagagaaggggaaatattaaataccttacatcaaatacctaagggcagacttaaggatttctaatccactgctgctgactgctggtattttaagacgggaactttcaaagaagaatgaatgttgtcagaaacatgattcctaacataaggaagcaatgactgggggctgggagatggcctatatcccttgtaagagtattttgagccctttagacaataggaaggctctctgacagtcttacttgtcaccaggcctctgctatgtccagaacaacagggttagaattcatggccccgccaggcatggtggctcatgcctgcgaccccaacactttgggaggtggaatcaggtaggtcacaaggtcaggagttcgagactagcctggccaatatggtgaaaccccgtctctactaaaaatatataaaaaattagccaggcatggtggcgtgcacctgtagtcccagctacttgggaagctgaggcaggagaatcgcttgaaccccggaggggtaggttacagtgagtcgagatcgcgccactgcactccagcctgggtgacagagcgagactttgtctcaaaacaaacaaacaaaaaagaattcatggccacatttccaaaatcttcatacttttgcaagctcactgcctatttcagggccatttctttgaacttatttcttcccctacccacataatcagtgtgaacagtctagtgtactgccttctgtatcttcctccatgtttctgcaataacatacaaatacaggtattcagacatgggggatggaggtcattttactttataatttgagattttctcataatatcataaaatctctccaagttaaccaggtatgattaaaattaatctttaatcacatctgagacattcttacaacataactgacatataatctatacttgattggtacacattcaatatgtgagatcaatttttgggagagaggaaaggaagcagtaaaaaagcttctataaacattcactatacatgcccttatatatgtatgctggtatttttatttttacaatatatatgccctcatatattatatacgggtgtttttctttgtatagtacatattcccaggggttgtaatactgggtgaaatagtttgtatatttttaattaggattatcaaaccacttttccaaaatatgtaagtaattcatgtttccatcagtcatgggtgaaagtcccctttaatcagcatccttacctgtcatgggtgttatcttttttctctctctctttttggccagtcagaagaatgatatctcatttgaattatcctaagagcaatggatagaacattgtttcatctacttactggacatgaggatttgctcttatgtgaactacctattcatatatttttcaattttcttatgggctgcttgaatttttctcatcaatttgtaagagctctttgtatattagaaataccaaccttatgcctattgcaggaattgcaaatattatctctatctaatgttagactttttagatggtttatgtcatcttttagcacagtttagtttaacgataaccaaattacagtctatcccttaagttgccaaaaagaaggaatcagcagaaaattctcgttctgcaattactaagataaaacatccagtgaaagaggaacttggaaaagatccagtacaaataaaactgcatgttcaagaatgctttcttaacctttggcacagatgccaccttgccccctccttggcttataagaagctgtcatacaccatcattaacacagttggtctcacccttcaatgcagatgttatagggtgctgctcctgaataattcttcaacctgggcaacgcatttaaattgggaattttcagctataattgttactctctgctgtccataggatgaagtctttgacccgaacctaaatacagaccagaattctgagcccaaaaactatctccagcatccggagaagaagcatcatgaaaggggaggagagagctgtttatatataaaataagttgaatttgcaagaaagaaccgactgtctttttctttaaaaattgtaggtagtatcaaagtttttctcctctttacagataaaaacaaaaaggctaacggaatgcagtcgaccgagaactagtttcttacatttccattgagggtatctttctctagatctgtcatttttcagaattttccaagtaataaagtcacaggcttttttgttaggtggctggaaagagaaatgtatttgtcattctgtctgatcttccaaagcatttttcagtgttgtttttgttgctgttatcttgttgaattttttatcagactattattggtatcaccaataaagaggatgttgaattatgtttctcattccaaaaatagtgcaaaaaaattaatcttaaaaagtataatggaatccacttttctttcactgactccatctgcaagccaggatcaactgtaaaatcattttatgaagaagcaatattgcaggggatttattctctgggtctaacagactgcttgcaagccagcgttaaagaccttgaacagttgatgcaaattccacctttgtattttactgccctcagtgagctcaacatcattcattaaagggtgtattagctgatatcttaccaccgccatgcagcagagaaggagaatcacataattttaaaattcaggctgagggccactgtggacgcagaaggctgacttccgaccacctgcttccccactagacttgttccaaatggctttcttgagaggtgattcacaagtgctaaaaaatcacgaatttttaaagtgagatattttggattacttataaactactttccgtaatggcattttaccaatgaaatgatccactggatgaaaatgacttatccttagttatctgttttattcctgagctcatctattttgacaagttcttgatcattgtgcagtacaaactatgcgcagccttttcacaaaggcttccctatggattctaggagctcacaacccaccgcttctcaacagacagtcatatattctactttacagcagaatacttctgcctcagggaatcctaatggccagtgccaaatcttgttttcactaactgtgagaaatgtgagccttatgctttacattaataggccaaatgtatttctctttgatagaaaatcaaacttctaagccactgataaaactctggtgacatcctgagcttcacaggtttgatcctcttacaaaaggtgtgaacaatgcaagtgaggttaacaaaaatccttgcagggaatcacacactgagtggctctctggcctgcatcactaactgctgcattttattaacagcaggtcaaagagcctctcgcccaacacatcacaaatgttcacagagattcaatgagtcaacaagtatgcctactgcagctggaactgacactgaaaatgtgaactacattgacaaaaattctcagcaggcctctcaaacacaaacttttccctagcccaaggtctctggggaaaaattataacaattaaaagtgcagtgtggagtgagaacacagtgcagcaaatttttaatgtcagaaagtagcaatttgataactaagaaaactggaaaaatcattataacctatgccttactttgcccagcacctcccaagactcaactggaaagagcctggctttgagaagaatgaaagcctgaactgctgattgtgagaaaaaaaaaggcaaaataagtgctgaaaggaactcacatcaaatatttcattgtaagagtctgatcttatttcctatagccagaatggcatttgacgatacaacagtggagaattttgctactaagatgttgaatgaaatccctcaagaggagaattacctttgagattttctgtcacttttaagatcacttctgaagtatcaaagcactactatagcaaatgaaatattatgaggagctttgcaacagatgccaataccttcccaaacatgtctgaggcatctcctaggtcagaggccctggatttcaaacatactgccaatatgtcaatgacccccagatacacagctctattcccaatcattcctcgatagcccacacttgtgtatctgtctactctctagacccgatgagaaatgaaagccttcaactcaaagttaacattgccctagaagaactgttgcgtttccctccaacccctatacctccccagggcttctctgtctcagtaagttgtccaccatccactcacttactgaggtccaaaacttccaattcattcttaatttatcttcccctctctccaatgcccaatccatcagagcaccacagactctacctctaaatatgtcaagcccatccacttttctccttctacactaacaaccctgtagtctgtgccaccatcacgcctgaccccatcatctgtgagagcttcaagctggtcttcctgcttcccctctagctaccctggaatccattctctgacccagtggtgaccttgataatataaccgacaatttggaaacgtaaataactcatatcccaccactgcttctccaaagggttcccaatgcccctaatagacatagaagtttcatgtcccggcttacaaagccctacatatgctaacccttacccacctctgtggtctcaattcacaccactgtccctttccccactacacacaaaccaatccaaagttgtcccctgttcactctctgtcacatgaacccatctgaattctttgcatagcacttaaccactggacaatactttttttatttattgtgaacgcaattattgcttatggtctaactcttccaccaaaaatgtatgctcagagagccaggagcctatctgtcttgcttacgtgcatatcgccagtgcctaaaaccgaggctcacacactacatgtgttcacacacacacacacaaatacctggggaggagggagaatgcaagttatttctcatggtcactttgactgcaattttcaagaaaagcagtcagtgtgtgacagcaacagtagaagcacgatttccaatcagacattaattgagacgaccactagcccttggtgaccccatgtacaggaagagatgtttcagggacaccatttgtttatacagatgtctgtccttaagggatttttgtttgaaatcaaccaccaatcatgtattttctgcaaggaaattacacagtaagggtgggttccaaccctcaaaatatttgctagctcagtgaaataaaaccaagattccatttggagaaacctatagctgctttactttgcaataaattgtaaaataggtgggttttattgttttataattcttttctgtaatagtctaccaagaggaatcccttggggacctttagaaaataaaaggggtaaaacacatgctgcattaagaagttatatattatccactgggctcagccatgcaggaggcctcagcatgaccttggcaagtttcttaacctcaccacactgttcactcacctttaaatggggataatattagaacctgcatgcttgttgagaagatgaaatggcatgcataaagcagtatctgggacacaggaagtgctcagataatgtaagcattatgaattatcaccaagttattagcagtgcttcaaaaaatatttcagatttggaaatgttggaaaatccacattattaaatttgtattgtggccgggcgcagtggctcacacctgtaatcccagcactttgggaggccgaggcgggcagatcatgaggtcaggagatcaagaccacggtgaaaccccgtctctactaaaaatacaaaaaattagcctggcgcggtggcaggcgcctgtagtcccagctacccggcaggctgaggcaggagaatggcgtgatcctgggaggcggagcttgcagtgagccgagatcacgccactgcactccagccctggcaacagagcgagactccatctcaaaaaaataaataaaataaaataaaataaaataaaataaaataaaataaaataaatgtgtattgtcattgctacattacaaggaactgtttaatgacttgctctgagcatgttcaagtgctcctttggctgcaaacacagatgactaccgcaggcccgtggaggtgacccaggattagctacactctattctttctacacttggggaactggcatgtgcttaagaaaagacaagaaaagctacttcaaatcaataaagtcttcacaaatcatgcacacgtgattagaaatgttcgttctgggtgtatctgatcatttagtaattgctcaagaaaacaagaataactttgtacattatctgccataaagacaaaaaatgagcaagaaaatgagagtcaaagttagaaaacaaacaaaacacttaatattataatcagagaactgagtcacactgtcataattcacttttttattgttgctaatattatgatgtcccagaagacacttctaagacatttacatagaccttaacacctggtttataaaataatattaaaagaatatagtccagtacataaaagagaaagttattttaaaaaatgaaattggccaggtgcagtggctcatgcctgtaatcccagcactttgggaggctgaggcgggtgtatcatgaggtcaggaattcaagatctgcctggctaacatggtgaaaacccagctctactaaaaatgtaaacattagccaggcatggtggcaggcgcctgtaatctcagctactcagaagggtgaggcaggagaatctcttgaacctagaaggcagaggttgcagtgagccgagatcccgccactgctctccagcctgggtaacagagaagactctgtctcgggggggaaaaagatgaaatcaactcctagaaaatactgcagcagaatgataaagtaaacatacaactacatatcaagttgagtcgagaagaaaggaatttcaggaaaatacacaaaaatgatagtggcttgggagaaaagaatagacctgcctatcaaagcatgtgttggttctctgatgaggtttcagcctgagaactaacatgggaaatgtgctgtccttctcctgctttactaaccttctgccttcttggttggtgcatccctgtgccgggctgatgaatacatcacaactgctgctcacagctgggaacacaaccagtaataaggcacagttatagcttcagggatgtaaggaaggtgagtgactgtccatactgtgcgtgtgtgtatccacagtcacacatgtgtatgtagcaccaagttagtgaaaaggttttatttaaaaggtgctacctaggttgtgattttcctctagtaggtggatccttgagcagcctacccctaatttgccacaaattcataattaagttacatagctgggtgttagtatactgttttacatatagatttcagagattttaaccctgccttagtgcacctaatgcagtagggtttcatccaattataaggctttctctatctgtttctatatctatttatctatctctatataatttacatacatgcatttatataggtggatattctatctttctgtttattcaactctatctacatatattacatatatgtgtgtaaatatatatatgtgtgtgtatatatatatatatatatatatatatattcaactctatctatctatctatctatctatctatctatctatctatctatccatccatccatccatccaattgacccagaattgtggtcacagcaaggcagatactcttaaacattagtgctgtcctctggacatgtacatccagataactatgttacaggaaatacaatttcagtcttctgagcttggctcaccccacaacctgacagtcatgctgtgctgcgctatttttatgtttaatatgtactccttgaagatgatactatgaaattccactgtaacactgatagtgttcaaatgctcactttaagaaaggttagatgccaggaaggaagtgataccgaatcctacagtgcaggaaagcagctacattggtttcggtcttggtgctatttgaatacctcaccttccttttctgttctcttctacatctcatagataaccattaataagaaacggactttagaaggatctcacagtctttcctgtctttggtacactgtaagtgatgttcaattacactggaaaacagtgaagactatttgagaaagcagtaaaatgaatggccccagctggacaatatggggacagtctataatggctacagcaaatataattatttaattattgtaaaattatgcaataaacttcttaaactaaatatagcacaatcagaaggctagagcagtacatttaatcacactcttaaggaccattagagaagttatattttacaaaatttccatctgaatcacttcattaaataacatatacgtattcagtgcttattatgtgccagagtgttaagtattgggaagacggatgcaataatcaagccaaggacttcacagtgtgaaaaggaaggactatatgtatttacaaaatactacaatgaatcctactttaaattgccattgcagggatgtgcacaggagtgtggggacacagagggggtgtgacttaattcatccggccatggagaaggaagagaaaggttcatggaaaatgagacagattagctgagaactggtgaacaagcaaatatctacccactgaacaatgtgggggaaattataccaaatgcatgaatctctgattggggtgggggaggaagaatcccattcctcttctcttagccaagcccatagccttccagctctgtgtccaaattagaaatagggtattactcatgcgattcagaaagtcccagaaaaatccatccatcaacccatctacacaacaaataattattggcatcttattacatcttagtcccttacctcacctaggaatggagcagtgagtgaacaaaataagcaaaatccctggcagggtagagcttacatgagaaggcaggggcagaagttatgtaaaattgataaacaaaatatctcatgtatcagacagtgctaagttctttacaagaaaagcaataaagcagaaaaggaaaatagagaatagcagggagactttccattttagtcatttgatcaggaatatctcctgacaaggtaagagttgaataaacttgaagtaggccaaggagcaatcttcagggatcttcaggtaaagagtgctgcaggcacagaaaggagtcagaatgaaaagactgagcaaggaaagtggctactctgttccagggagaccaaggaggccagtgaaactgaagctggtgcttgggagagaaagatagatagagaagagagaggatgaggacaaagaagggacacgtggtgcctggcgcaccaagggaggaagctggctttccatcagaataaggcagcagctgctggaggattctcagcagagagcctgtctggtcactgtgtggagaaaagaccacggaggcccaagagcagaagcagcgagacggccggaagacctgagaactcacggggaccaagttgctgggagcttagctgaggcagggagcagtgaaggtgctgagaagtggtaagatattggatatatgttgaacaaaaaaacgaacaacaataagatttgttgacagctgggatgtggggtgacagagaaagagaataatcaagtattgttccaactgtttcagcctgagcaagtggaagactggacttcccattaataaaatgaggaactctacagaaggacatggctaggggttgtggggagaaaagagttcagtttggacatggttaatttgaagacataaattagacatccagttgtgaggttaaataggcagttgaatatataaacaattctggagcttagggataggttttggctgaagatagacatgtgggagtaattagtgtgcaaatgatactaaagccatgagactggaagagatttctaaatggtgagaatggtgggaaaagagacaaggtccagacactgaaccttatgggactccagtgcttggatggcagggagatgaccatttgaggctaagatgcaaagcccagagatatgaggtcaggccagagaaatggagcatcctaaagccaagtagagaaagtatgtcaaggaggtgggaggggtcgatggtataaaagctgctaactgttaagtatgatgatgactgagcctcgactgctggatttagcaacatggcggtgttgggtgatcttgactaggcagtgctgaaggaatgactaagggatcagactgggctcaaaataaaataaaaaggcagaaatggaggacaacaagtacaggcaaatactttaaaccaagttttttttgttttttgttttttttttagcaaagaggagataaatgtattataactaaagaggaaattagaggccacaggtcaaattttcttaggatgatagatgtttccattcctattggaaaaaaaaataaacagcatagagggaaaaataaaagctgattatgtaggaaagaaaggaaataactgcttaagtactgtaggagcaaaggaatgggatacagtttggccaaactagggttaagagtttccatcagaattaatcagtgtccactagctggaatattgtgattggcccacttgggtaggtacctcacctttaaaacatcactgtagtaaggaggtggcctgcaatgaagaaaagaggaacagttctcaaaaagtatgtggcccctgagctgtgataagggtaccccaatttatatgtactaaaaaaaatctgagctacagtaaacaacttagatcaacccacttaattcctcagcactggaaatgtaagtgcactattcttagatactgttacatgaaaatgtggtgatatttacttcccagaatctcccaaccaacttcccaacctttgctttttctgctttggtttaaccaatagtggttactgctcaggctttaaacaaaaacaaatgaagcaaaatgactctgatttctttgtggcctcggaggctcaaaaagacacaaacacacatgaaacccccactagctttcctagataaagcatgaactgattaggtttgcagccctgcagctatagaggcctctccaatactctgatctggaaaccacagggcaggaaaatccccaaagtcccatgaaatccaaagatccaaacgtggggtcgtttttatgccctcaggaaagttctgccaaaaaaagagatcttacacacagtgtaattgagagggcagtatccttacgtgcacatgtaaatccaaatccaagcaattaaccccacacacatctgcccctctaatgggtgtctgagaataaacagcacacgtcaatccctcccagcctcactcaatcacgaaactaagaaaagaaaatgaattctgaacttcaccacacagctgtgattcacaaatatttatagtagccataaagctggtgaccttcaggaagataacacacttggcagacattcacctaaacaaaagaggggaaaaggcccaaatctcaaacagcagagaacagagagagaggcaagatttcccaagttccataatggggaattccaatgcattctgatggagataatggaagctgacaattctcctgtcagtgagctttggtaagcggagtgaaatgcttgtgacaaaacagatcagctctgcacgggcctttctggatggcctcacagagattttccatcaggctgagtacacaatcggatgggactcaggagtggtgtctacagccctgtatttctgacattattaggaatgacaggctaaacctttatcccaaattacaaccactcagcatgtttaagcaagtgtgtaccttgtatcaacaatatacatagagatgccctgaaaatatcacaaaataaaattcctttcaggaacgtggcaccgaaagaaacaccgtcagcaactcagcaagcactttttttttcatatttggtctctttgtctagtttaaacccctcattacctattatcacacccaaacctatgtcttctcactttccttattttatagccaagaaatctaacaaaatcaagacaagtaaagactgagagctgactcttggtccgatctgtccacggtcaggtggttatgaatctcaaaaagcgagatctagattcaatcttttggaactcctgcccttaacattattgtacgcacatcacaacaaattactattttacatcagtgctcgagactgcacaaacgaggacatcttatttgtgatttgaccagccttaacttggtctttgatacccaccatgtaacatttaatgcaaacaccttaagttagctacaagaatgagccaagaagcaaagcactgtgatcaggatttaatcatggttaatataatgggttaagttctataaaattttttaaaaatgaaatatagttgttaaaatatagtcataggttatataaaatcttaaaatagaaagttcccttctccctaacgaagaatgaataaaagaatgagaaaatttaagttgtctggttctaaactaggtctctatttgtagaaaggagaagtgtgtttctgggattttctcccacttgtacaaatattgttattgtccgaacatccacaataaattaaaattggggattgatttttttcagtgaggacaaagaaaggcagaataaaacattgagaaggttttaaaaagcaaaactatattttaaatatctgttcctgaattaaacagttaaatatttttaatacaatcagaagaaagtaaagaatttttgttcatttttttactattcccattttatagatgaaaatgttttgttttattcctaagcactgattaaaatcattatcaagaaaaaatctgacatcactaaaataaacttatttaaatttaaaaggataaagcaaacaagcaaatgaaatagcggaaaaaacagtgacaataatgagttaatattcttaataattaagccttaaaatctgtaagaaaaatgttgagtctctatagctaaacagttataaaatctggacaaataattctcacacacgcttgtttgtctctgtctctctctttctctcccacccttccctccctccttcccttcctcctttctctctttctctcacctcttctcagagtaatggctaattattgcttgaaaaaaaattagcaaagaaacacaatgagtaaaaaataaaatatataaaaaaagaatattatcaaattgactaaaacaattaataatactactcaaagtttttgagtaatgatattcaaatttgttttagcaaaataaattctccagcatataaatgaagtataaatatctacaatacttttacaaagccaactggcagatttttaagactccctgggttttatgtagtaaatcaaccatagctcttctgagctaatgaattaaccctcaattaaaagaaagtattacaataacaattgctattgtttttgaagcatgtacttcatgcaccaaatacagtgacctgctcaaaatgagaaagcaggattggaactcaggtgtatgaagtctcccatcacccttttcatgttcatttcagcatggtctatgacttttgtgaactggaagcaacatatgttccacaaaagaagcaggaaatgacattacagtgcctttacacgatagagtattacatatacattaaaacaagggttttttcttcaatttgcaataatatgagaaagtatgtataagtgaaaaagcagtatgcagaattttatgtctagtattatctcaactctttaaactgcttatcaaaaatattccataaaagactacattaaatgtcgtctgtgattgtcttcaatagaggcattatagttgaattttcctcttcttttatatattttcagtaatgagcattcactacattaatgcactttaaaaatttttttaattgtaaaaataataatactcctgaaaatcttactgaccacatggatgataaagtgcaaacacctgtactccagagataatctctgtttagagtatggtatatattaatatatattctaggagactttataatacacatgaacttgtgcatagagattgtgtgtgtgagtctgtgtttatttttaagaggaatgggattatattaaatatattattctgcaatttgctttctcagttaataaggaatcaaggatagttttccattacttttatggtcagaatttcattttttatatcattgctattaaggtgaagcacactttgccatggcacatggaataagtacctaggggccagtgctccttgacaaaggcatgtctccaaaacttctgctatattatcaggctcttgagtttgctgcaattatagatttctaagaatgaacgaatgaatgagtacaatagttccttgcttaaattgcttaaagaaacacaaattaattggtctttcaattttctttgcccatctttgtaaatgatatagtagagagtcaaatatgcctttaagtatcagaagtatccgtttgtaataaaaaagaaaaatttaaaaaatcataccacaatttatttatgtggcaaagggtattgccatgttatttcatcatttaactatgtcaatcctgttcaaactccatctttgctcataataaaagagggatattcgagaccagaccagaacattcttgttcaacaaaattatcagaaggcccaagataattgcatgtttaccctaatatatataaaaggcagtatgtataagggtgcaaactaacagtgtcacattcagaaactatataaaaaccaaagtaggaaataccatctaaacttatttcataaatgagttatatataccagcttaacaaaatgtcaagaaaataatatttaccaggccctaatttgagcaaagctgtaatttaggtgggacttagactaacacatttggggcatataaaccatgtcaagcaatagaacatcaaatgtccttattctaaggggtaaggtttgcagttacaatagacttcaataaaatttgtttataattaaaatccaagcatccaagataaattgcactgtgggactaatacctactgtccccgaaacactctcattcactatactatgaggtcttcggcagtgcaaggatcgtgtcaatcatagctcagaaagctgcttagcctggaggccaaatccagcccaccacctgtctttgtaataaagttttattgtaacacagccatgcccattcacttacatacctatgactgctttcatactacaacggcagagtgatgcagcagagactctatggcctgtaagcgccaaaatgttttctcacactttttagaaaacgttcgccaattcttgatttagattactgtttgaaaaactgatttcttaatatttgttctgagtttctctctacaggtctgagtaactccagtaaggaataaaaactaaaatatgactgttcttattctagggaggcatggttagtgctaaaaggcagttttctgtaaaggttaagaagatagaatcaaatcccagctctgcctctgactcactgcaattctcttgcagattatttaagctctctgtgcctcaatttcctcatctttaaaacagtgacccaagaatacgaacctgaaagggttgttatgagaattttaaacatctcactcagcacagggcctgacacacaatgaggacttacattagctaataactcttcctatcatatatcatgataaccgctgaccatccaaagcaagccaacacaggctccatgtggtcattcttccagctctcaggtgctgtggttctccatgggggagggaacgggaggttccggttaagacactatgtgaacctgaatctacgtgggctggagaaagatacaaaatgcagacctccgtttcttcttctgcaaaacgtaaggacgacacaggagaacctctcgtctcagctgagcacatctacacatctatacagagggcccagctctaagacccatttagcctccttcctcatagacgaagccagggactggtaactcataatccaagagcaggaatggtcaccaattattcagaaaatctctggattatctaaaatcagcaaagtgttttgtgaatggggaaaaaatataagcctgtccacaatgagacggtaatttagttagggagaaaaataaataagttaataaacaatggtagtgtctttgcagtgactagtatatggaatgaaattgtcactttctctcactttacttgttcctcccctacacaactagtcctctatcccccttcaccccttcctctcttctagccttcccagaaggtagcaacacctaggtctaaagtgcttcagaaaggctcctgtgaagccagcatttctgagccagcctttggaagatccaaacaagcacgattcgtggtgggaacagatcattgtgaagtggggggtcagtccctacactgtcccagggccacaggaaggaggaaattgtgtggaggcctgaccaggaggatccctgagagtatcatgagaggtttagggcttacccagcaggtacaggggactgcagaaggtcccaggacaggaagtgagatgacagtggtatgcactgcaaataagtgggggcagcgcacagaggtaactgcaggagacaaaactgaaaccaggtaggcagtcacactggggcgcagaagatgctaagaagcatctaagccttttcacgtcttcgggttcctgagtgatgtagcggtggtatatgcccacaattgttttacttgaaagatttctctatctgaaagcttgctcattaactctcatttttttttcttttcttcttttcttcttttcttcttttttctctgagatgaagtcttgctctgttgcccaggctggagtgcagtggtgcaatctcagctcactgcaaactctgcctcctgggttcaagtgatcctcatgcctcagcctcccaagtagctgggattataggcacgcgccaccacgccaggctaatttttgtatttttagtagagatagaatttcaccatgttggccaggctggaactcctgacctcaggtgatcagcctgcctcagcctcccaaaatgctgggattacaggtgtgagccaccaagcccagcctactcttatttttaataacagaagtaaagctcacaagctgtcaaaaatatttcaatctgtaatttttttagtttcttcacttcccatttagatgtctcacttaccaaggagagagaggatggaggacgcgtttcctcaatcatgaatcacactgactccacagccacgtgggcactccagcccaagtctcacacaccaacacttcaaaaaagaaaatagagagatcctgtcaacccattttaaaagaggatgtggtcattggtcatgagttctatgaagttccattaaagtcctaaacaatcagagcaagctgctttggccacgtaggattaaagcagtgacgcaggccagcttggcatcacaatcatgctaccctagttcaggatcatgtgcactaatggattctttttcttcagaaaaggagaaataaaacatttaaatgctgttaacagatgaaataactctcataaaacatccagaagaaccattatttcaaaattatcttaaccagtctgaaattatctaaagcagtctgaaaattaaattaagattcattatatgaatttatccttttcatgactcattccactttttggaacacatggtaccttatacaattcaagaacaggagacaaaggcagtagcacaaactctgctagaaatttgagtttgtatttttatttacatactgatttattaggtgcacaattatgaggctttataggaaaaggaatgatgcatcgtgaaaaacaagccactttaccaaaaccaagtaaacctgtccaatctcgtcattcaatttcatatacaaaaattctgaaaccttgatgttgtcattggatggaaagatgaccacgaaacgccagcctccctagaaacatgtatgccagaggctgaaaatataggtgactttccatctatgatccatatgagaaatgtgttcatcaccagtgaaggatgcctgtgacttcaaatactgcatttcagggctcatgcttttttctgttctcttcattcatctggtttttctctacacttcccaggtggcagcttctggctgctataaatgtgaaacaccctgacattcttcctcgccaccctgaagaagggaaaatgggagaaagaacttcccagaacattctggctgtccctctaggcagtgattcccacacggtcagcttcagtcatgatccgaggccatctgcctgcagaaaatgaactgaacgacagcagctggaaatttataaaatgttatacctgctgaagtgccattttggaagccctagggttcagaggccagggaacaggtcaaggtggcactgcctctctatgagtctcccttcctccaggacgggcctttggtatgttcatgggaagcaagggggtgacccagggcaacacactgggacatgcctgcctgagacgccccagcagcccaggcaccctcatatcgtgcagcacggccaatcctccagtcccagcagagtcctcaaaagtccgtgacatcatcctttggacaggagaaggtgcagatgcaaatccttgaagccaaaagaggagccagggaagcacactcagtctcagaaatattcctcagagtggccaatttcttttacacaacatcactaatatcacctttgggcgtggcaacaaaatatgttagttgaaactcctttattaaatggcatgtttgaatacacaagcatcctctctccagtcctaaaatctattttacaacaattattactaaaatgtccttgtagttgtttagatctgagttgaaatgtaagtaataaagtttgacagatcctctggttaccgccatgaatagctggcaatttctgtaagttcccatgtctcagaactacattaaaaacagggctaataggtctcctgcctcccccagtgaggtcacaaatgagctgatgtgaaccctcagctggacagcaaaaccacacctgcagaatatgggtcagtctcttaaatgaaagagactggggccaaaaagatcattgcaagaattcacaatcagtaacacaaccagagagcaaatactgcaggaagaagacatccctgccgaatccagcatggacagcccacagcctggaccgccagacagtcctggtgcaaccaacagactccaaaacccagccccttccttgtggaaaagcaatacccacaggacagagctctcttggcttgggggaaaacacagcttcctacagagtttgatgtctaaacaggaaatcagtctcagcagcaggattcaagggtgtccacccgaaagggttgttactgtgcctgtgtttacataaatagtgaaaaagatattttaacagcctgggggcttgtcagccaagtgagccatgttgggactttctgctcctgagggtcagcccttgcctggggaagacagggtgctcaccaacacacccatgtgtgcctgggaacgtgcactcaggaacagaaatgatagtgacaaagcagaggccttgagttggagccaagctagaggaacagacaatgattcttgcaggtccagaagcagagcccccgtgtcctctcccagcaaggtcataaattagccaatgcattaatcataaatcactgacatattttctagaaaactgagaagaaagctgaaaggcaaagaaactacaaagccccagaggctcactccagactggaagttggaaaatttttaagcgacagttaactacccatttaataagaaactgcttattttttataaacatataaatttctctatttgactcaattccatattatccttattcttttctcttttagcttagctttaaccttggtgccaacaacctctgaaatcctctgagtcataattttcagagttctgcctcttaaaaaatgccaccatgaacatatatgtgcagaactatcttgacgacacttttgatttacaaacagtaactctttcccagaagttttgccctgtggccacctacactcttcaaattgtctctagatggaactacatgaagaagattgaataccaattataacttactaagtgctcatcagcacatgactttctgctaaaatatgcaaccttctccctgcccaacttactcagaatgaggtaagatgtagacttaagcattattttggagaccaaagttgagctgagtggtagcctttatcctgcagatacatggcagaaattaacatgccaggccagtcttatgagctgaatttagaaaccgtacaacagtaagattacactggaaataaaaatggacaagaccacctggcatcagaaagtttagtggagtgatgaaaagaaaccgtaaaagatacaggttcaagaaacctaagaactgctgggccagcatttcccaaaggcaagacttagaccagtgccatggcatttaattgacaggcctctcatcatcagtccctccgttaatcaccatgcacagcacagccccatggccacacatggtggatgcttagaagacaaaacaagaacctattacactctcaggagctgtctatatgatttttctgctatgtagttcagtatatactatgaattggaggaaagagaagttacttatgggcagaagagtcaaggaaaagatttctgaaaatgggaaatgtgatgtgggctctaagggatgaggaggagataaggaggatattaaaagacacagtgaagtatgttttagtgggtgcattgcaggtgaaacaaacagtagatgagggaggaacagctgaaagtcatcaggtataagagaagagccatttacgccagcaccatggtgagttaaagcatgagttcctggtaccatccctggagttgggtggaaaccccaccacggagcccaccaagataagagtttgcaggagtgcaaactgaatgagataggtgaaaaaaagcaattccacaaaggtaaaaatctggactgcaatgccataagaatcacagacagaaatctggcctcatgctcaagtccctggaggaagacaaggaagtaaacaggagggtggattccaggtggcaggccaaggagcagggagggtggcatcaggagtgtgtggaggcagccagcatcggctagcagcagcatgtgccacgatgactacctgcaagatcactcacatgcaagagcatggagagctcaaaagaggcactccagacagctaacagatgggaaaagtagatgacacacagattgtagggaatgttaacatgagaaagagatgagacttcatccaaaggaaggcagagtcactgaaggttcagtgggatgtcaggatgagcaaactttgggagggtgaatatggcagctctgcagaggatgcacaagacaagaaggggagaagctggggtaaaaagccgccaccagagaactccaggtatgaggagaattgcagtgaaggatgaacatggcccttgccaagcaaaggacttgcctttgccaagttcctgggaagtcacctctaagaccttagaatgtcctgcctgatgagagactttgttttgggggggctttaggccacacagatagtctaggctaaccatgtggttaatggctgagggcttgggcctctctggattagtctggccatgtctatgtggtcaattctcaataaaaactcaggacaccaaggctcaggtgaagtcgcctggttggcaacaccctatgcatgttgtcatacatccttgtgggggaagaagcactgtccacgtgtctccactggaaagagaccatcagaagctcgtgactagcctctcctggactccagctatgcaccttttccacagctggagtgtaaagggtactactgtaccctttgactgagatcaaccataatcactaatacaacaggttttacacattcttagagttcttcatgtaaatcattgatcctgagggtgcccatgagccacatggcaaacagggtcagggggccccacatgactaagtgtgcagcttcagccctaaacatcaacatttaaaacccaggagcaacaaatggcctatcgcattggaattattcacaaagaaaatatattccacattcccagaaatatattaactatctaaaatagattttaaaatatgctaaataaaaagtcaaaacatcacagtccatttttgcaaagaatcacttatatagaaacatcagtctaaaaactcagcatgtacttactgaggaatgaatgttcttgaatttagggcaataaactaaatgacgaaaatcagaattttctcagtaggaatgaaaatacaaaatgagtaaaggacactatttttggaattgccttcatccaatgccaactggtttgattgacaggaactatgtggaggacccagcactcagatgtgggctgtgggataatgaaacgccattcactctggttatacgcactgcaaccctttctgtcactgtccgtagcctgggtgtccaggcttccattaggtcacttctgacagcctctgtcacttgttccacaggtggtctccacaggaatgtgcttggataaatcgacagtggacatttaggataataatgtcccttgaaagaatggcaatctctgtggctgggggtccttggaaaccccagccactcaagaaaacaaagagtgggtgacaggaacagagaacaaggctttgaggcaaaagttatagggaagaaagcagagagaggggagaggggaggaagagcaaaagaaaaggaagagggggaagaaaaacaccctagaagcagctacagggataacaggatgtcctgaaatggtgcagccaactgaaaaatatgatataatctatcattataaaatggacttttattgtttccttcaacttttgttaaaataaattttatggaaaactgaggtttacaacatgatgtaatgggtgacatatagatagtaaaatggttactctagtgaagcaaattaacgtatttatcatctcacatagttacattttttgaggtaagagcagctaaaatctacttatttcacaaaagttctaaataccatatatggttctcacgcctgcattagtatctttgaaggatacaaataacagcaatgtcagcttcaggtacgagggaggagggccagttcctggccattcccttccactggcagaacgtctgctgccagctaccaccacattcctgggcaaatattccagcattcaaggaaacaatttgaaaaggaaaagcaaaatgcacaaaagcttgaggtgatgaagaaattataggatgaaggcagcagccagccccaaccactcttaccatggtccagggagcagccgcataccccaccccttctctcctctacaggccagcactggctggggtcagaggctgatccatggagcaagtccattgagactcccaaatatgagattgctggccactttacattcaagacagggtcaggactcaaatgaaaaatgatgtaatttttaaagatagatctctggatttgttcaatatcaccacttaaatttttttttagtttattttttttaattttttttttatttccaaaggttattggggaaaaggtggtgtttggttacatgagtaagtgtaaccaaacttttgtggtgacttgtaagatcttggtgcacccattacctgagcagtatacactgcaacctatttgtagtcttttatccctcacccgctttccaccctttcccctgagtccccaaaggccattgtgtaattcttatgccttttcatcctcataacttagctcccacttatgaataagaatatacaatgtttggttttccattcctgcattactccacttagaataatagactctaatctcatccaggtcgctgtgaatgccattaattcattcctttttatggctgagtagtattccattgtatagatataccacagtttctttattcacttgttcattggtgggcattttggttggttccacatttttgcaattgcgaactgtgatcctataaacatgcatgtgcaagtatctttttcatataatgacttatattcctttgggtagatacccagtagttgcaccacctaaattttgaacggtatttgacattgtgatgtctaaatgctgagagcggagttagaaagagatgggatatagtgggcccatctcttaacggtttttctttcttaaggatgttcctttgcctcttggtttgcccgcaccggcctgaatacagaatctgtgcaggaccccagccaagctgtgcacagacaaacaggttctgaatgaagtggtgtctctagcagggacagcactgatgcaaacacccatggcttacacattagagaccttacacaaaatgtgggacaaaataaatgcacagagaaagaaaacacacacacatatttacaatcagatcgttatagatatccaataatattgcattccaataagcaaataaatggccttactttccacatcagcttgaacctccaatcagagaatttttcctgcatcccagtttagcatgctggatgttgtgctgaatgacgtgcataacaccacaatgacatgggaggtctctgccctcaaggaattcagcctttggaatcgcttttccccaaatcagaaacaatctcattaggaaccagctaatatttgatctagaaataattccacatatttaccaagaacatttaataaagaatcccttcggtaaatatctctcgtgccattaaaaaaaaaaaaagtgggccgggcacggtggctcacgcctgtaatcccaggactttgggaggccgaggtgggcggatcacgaggtcaggagattgagaccatcctggctaacacagtgaaaccctgtctctactaaaaatacaaaaaattagccgggtgtggtggcgggtgcctgtagtcccagctactcgggaggctgaggcaggagaatggcgtcaacccgggagacggagcttgcaatgagccgagatggcaccactgcactccagtctgagtgacagagtgagactctgtctcaaaaaaaaaagtgtcagatgtgagattccccttcactgagtctctggctcccacagggccaaagtaagaacacctggagaccagtcccagaggtcaaggcctcatggacaataagtccccatgtgatgacacatgacctcacacctgggtcatttaatcatgcaaatatctggctctatgactggcaggggcaagttctactttcctgtacagaagagcaggcacttctacaagttgtatccaaagagtaagatggcatgaaagagaaatactcttcccacttggagccttcatgcccagatccagcctgagacccctctctccatcagacagtagtcactgtgaatggaatgatctagaaatattaaacatagctccgagctaaagaaaaataaacacagtaacaggggattttgtttctcaaagcattgactaatcctaacaacagtttggaaggaagaaatccaattgttttccattttgtcttcatgcagattatcctttggtgaatatttaaagctagtagaaatagctggcactcagtattgcctcagtaacggaaataaagctggagtaaacacttcctatttcattactctcacatgagacaatgatgtgttctgaactgcaaagaggcatggggctgagggaaagaaagagagggggcaaaaatgacttctttattaaagcaaacaggttgccaaaaactaagcaagtgctcaaaatgagcaatttctgttatgcgctctctaaggacaccagggcctcagaatagtgaatactttcttattttggccaccatgtgccagattttcaaaaggccacctcacttttcatgcaggcaattttgaagagcttgcacaaccagttaatttgcaaggacagccggcctctgggcttccactctgacagctaaattgatcaatcctttgtagaggaaaatctcagtccctagaaaaaaagggtgtctgagaccctttgaaaaatgtggtctctcaattcctacttattcagaactacacagccaacaagacttattctgtaagcagtagtttgcctacacaaaggagactcaagatttaactctagatctaaatttaagatttaattttaatattaagatttaactctttaaaaaattatttgactactcttgttacttaactatctctgttaaaacataaaaaaagggctgggttcttatatccgccctctggtcattacatagaagagcgaaatgccggccacagattaaaccacatctgacaccaaacctttctcagagaaaaagctgagctgaggcagacaagtctgttaagaaatatgaaaacagagaggggctcatttatcccataaaagttggctaactgtgaaattcacaatgaattattagtgaaatggcaattggttaaattgttcagaaaaatattttcctaaaaacagaacaggcagtagatttttagaattttctagctacacactcagaaaagagaaatgaaaggatgtgctccttcaactcagtaatggaaagaagattagtataaacccgtgcaagccaatccaatgtgcatattgggctctctgtgacttcacttattttagatacctaagccctagtgtcactgttttacatggtatacaatgatctgggccaagccaattgcgttttgccttggaagacaaactctgatgttctattctggcttaaacctagtgaatgttctggagtcattttagaatgttcgcttctttgaacacatgaaaaagaagacttttaaatcctcctgaatcagtcccaatgacctgtcaggtctttcatcgtccaagatgggcaccaaggcctaaagaagaaaatagcatctcattttcgcattacggcatgcaggcaacttgctcaggaatgtgaattccacctaaacgtttgtttcatgttttatagaggacttaacactatatgaatccctgagtgtgtcgcacaaccaaaaatctaattctgttctatttgtcatcccctcaatataaattagtgattaaaaatgagaaataagctacaacacaacaaaccagatggtgtcttaccttcctataaacactgttgtgtttagagagtttacacatgtgggggaatgtaatgacttatttttttcacatttggcaatgagtcatgtcatccattttagcacaaactgtcctgaaacttcctcccaaatgaagacatggaacagtttcactaatatgtaaaagcacccatgccagctgcctttgattagtcatgatgcctctctgcccactctacagccctcatctaggagacaacctgatccagtcggacacccaaacagaaccaaaaggtcggcatgtcctgaagtcaacctgctggggaagcagatgcacttttggaggggccaagatgcttcttccctttgcttcccaacacatacccttaaaaattcaacccaggaacttgatttaacagtgtcctcctctttacttttgacactctccccaacctttctgagctatcctatggacctaacatatagaagagaaaccatgaataatctcaggaaagttctaagttcaccaattattaaaggagccagagtctatcccaactgccaacattcaatggatgtccactctgtggaactaaatgggaaggaaacaagaccagcctgaaatgcaaaccatgtttgacaaaactgtgtttcattattttacactgacagtgcttagggctatgcctgacacatggtaaacccctagcagggagttagccccgccccttctgcctaccccaacagtggaattgggtttatgtttccccttcatcatctgtcaagacaactcctcccctccctttgtggaattaacagtattaaactgactgctggtgttagtctgctttttggttttggtttgctaagccattgagatagtaacacctctcctcgtggtacctgtgaagtttatttatgaaactaaatccagatctctgtaattcttgctctttagattttatcttattggcttgacttcatcactgaagccattcatcctaacatccctgcctgctggctctctgaaatccaggtggccctgacatccccgtgtgatgttgttgcctctcctctgtgaccgtgacatgtgatgctggcttttctgtttctcccatcaccctccattgtttacttctctgtctcctggtcaagggcaggcatctgtcttagtcagctgacttcacattcccaaggccaggcctaagtaaatgagcatattcaagaacaacagtttggttggtgggaacgtaaattaattcaaccatttggaagacaggtggcgattcctcaaagacctagaggcagaaataccatttgacccagaaatttcattactgagtatatacccaaaggaatataaatcattctgttataaagatacatgtacccgtatgttcactgcagtactactcacaatagcaaagacatggaataaacataaatgcccatcagtgatagactagataaagaaaatgtggtacatgcacatcatggaatactatgcagccattaaaagggacgagatcatgtcctctgcagggacatggatgaggttggaagccattatcctcagcgaactaatgcagaaacagaaaaccaaacaccacatgttctcacttacaagtggtagctgaacaatgagaatgcatggatatatgggggggaacaacataccttgggacctgttgggagcatgggggagggagagcatcaggaagcatagctaatggatgctgggcttaatacctaggcgatgagatgacctgtgcaacaaaccaccatgacacatgtttacctctttaataaacctgcacatcctgcacatgtaccctggaacttaaaataaaagttgaaggaaaaaaaaaaagaacaacagtttgatgaacatttctcatttttatctcagaatgtgtgtaaatattaacaggggcatatccctaaagttagctttaacatcagtcaaaatcacccaaaaatgcaggggaaattaacccgggtggtacctggagatgacctaagcctcacccagatctagaagataccacacacacagaaggtgcctgggtaacgtttggcagatagcagcatgcaggaacccctttcttacaagttgctagagaaaactgcagcttcctcctccagaggctctaggcctaccttgatcccatctttcctcacaataaaattctcttttcaatcctccttaggaggttttctagtctcagaagaagccttcaatgctgttcataggagattaggtccccctgttttagataacaatggctgtccatcctgttcatgctcataaaagctcaactttgcacagacttccctgtgcaaacataccgatgtctcccctcttcctgtccattaagctgagtcccctataccaggatccttctacagacccccttggggcggctgtctccactgcccttgagaaccactctcagcctcagagacatttccagaggagaagggctgctcatgaacacagtcaagtggggagaacgaggccaacccggtggccaatagggaccaagaaggaaaatagcttccccttagaaatataaacattatctttgtaaatgtcatgcttatatggataatccacttagtaagctcacttttcatagatatcaggccagttgctaagtatacattgttccagtatctgaaattaatgatattcagtttaataggagtgttcctctatatagcaattctgcagtcattgattaaaacagtcctcacttttgctgtctggactcccattctccctccataatcataggcttcaggctccttcacccatccaatgacctgaaagcatctcccttgctgctgcctgtcacacctacacccctctccactcacccagctgtcccctctccccagtcagccacagagaaaagtttgaaggagctttcttctcactgcccagttttctattttacagaaggctttagaaaacacatatgtgctctggctaaaataaaagtgaagttataatgtgatctaccacatcaaaaaaaaaaaaaagaaacggaaaatagttttagttaattcagcatcagaaaatcaatatgtccttagcagcattctgtgcttgacttcaaaatgtgtgttttaatcttgactttattacatgttgtacttggttagctcacacttagaattctcatcaactgctttttaggtctgtggatgggaaggtactccataagagaaatcagcctaataattgaatacagagctttaaaaagaaaggcttgtataactctgaaggggacaaaacaatgacgcagaaataaagtcagactacagcagttcaaagacctgtccttgtttgtgattttttttctaatatacagactcaagggttcaactaagaggctgttgtcggttacgcttctcatctatatcctctctcagatcagcagacatctagccactctgctgcatgctaatataaaatctgtctctgtctcctcacacatcccgtcagagaaaccatctaatcatgaaccatcctatcattacagcagccactgtaaatgcttgggaaattaaacaacaaacaagactcctcattcaaatggaaagctggcagcattgttggggagatgacaaaacccatcattagactgggaacaaactgccttgccctatgtgccctttactgcttctctttttcagggtacgctggaagaaggggcatagctatccattattcactgacaatctcataagtcatgccactttcctaactattgtaaaagagccatagtcagaaaagtggggtgaaatgttggtgacagctgcttatctcaaaggcttctaaggtaaaccaccaaaccataatttgatgcaataatatggtggttattgctattccttgaccaactactcccaatcccttcaggttagatttctcctatttttacattctggagtacacagagttctttcaccagtagctaagaagatgcaaattgatcacaacctccctgaaataaaatgaggagggtaagaaatggcccaggtttcttgattctctctgctgtgaacctggggccatgtcaccttccccgtcttctttcctgcacggctgaggatggcagacagtaactctccttagcagacaaggcaatctacccagcatggaggaaacaacaagtaaggactgaagttctacccgagccacctggtagaagaggaggaaaaaaagatgaaggaaatctgaataattgaaaggcgttagccctacacttaatctgcctgatgttacataataaactctgtcagtagaaacagactcttcctttcacccacttccttcaccttttccaccagatttcttccatttgtcacccctacagctcagaattggccctgccctgtctcctaatgctgaggacagaccattaaaggaaggaaggtcagagaaattacaatgacatggctttgttccccaagaacattcactctggaagctgtcactgctcaaaagacatcttcattctagctcatatggccagagggagcccccttctcctcaattccaatttgctttgacagacacatggctgtgaagcagtggtttgcttcccggagctgaagctgcactggaattccaaagctgccctagccctgtcaacagaagtcagcagcttgaagaagaactgctatccagtcacagccagcgttccctgacacctgataatacacactctctcaggcaagatgcatcccacctcagattattccagccctgcctctaattgctcccaccagggcaaacagggtggcattctgctttggaaggaattattaaggctatgttgaaatgaaagtcaaggtgagcccccgcaaatacagctgcattttttaatccagaccaaacaaaactttcttttagcttctagccacactctcccaaaacaaaattttaaaagaaaaactgagatgcaggtctaaattatataataagaggaaccccagtttccctacccagtttgttactgaagaagctatttattacaaaagctccagagtcactgttctcctccaggtccatgcagaagcaatgaagcccaacgacaataatgccatcaggagggcaggcaaaaagctcgttttaaggctcccaacggggtctaatacatcatccaggaagaaggactactctgagaggtgcctcagagggaaaagcctgtcaaatgactcaatgccaccagactctgatctgccaccagaaatgctgcaaccaccacagatactcactgacatagacagaaaatcctgcttcattatcctaagtctaaacacgtactttatacctgtgggattaaaagtgcaaaaggagtcagatcagtctagatgttatttattttacatagtaattgagattcataaaagaaaaatacagttggacctcattatccagagattacatatttgcaaattcacctgttagctaaagtgtatttgcaacctcagaatcaaaacttgaggcacttcccagccattcatggacatgagcagtgaaaatttgagtctcctgacaacaggcattcccagccgaggtctgacaaggcaatcctatcaccttcttgtttcagctctcatactgaaaataagtgccacatcctctatttcgtgccacattttttgcactcttgtactttttgttggtgatttgtctgtttaaaatggccccaagcatagggctgcagaactggctggtattcctaagtgcaggaaggctgtgatgtgccctatgaagaaaatgcatgtgttagataagccttgttcaggcatcaattatagtgctattgaccatgagttcaatgttaatgaaccaattgcatattaaataagttgtttttaacaaaaaatgcacttgaaacaaggttatttattgatcagttgacaaaaatatggtgaccagaggctcgcaggaaccaaaccctatatttcccctaggagcagtggttcaggatttgctaattcagtatttgcagtgacttcatagagcataattaccacatgctctcaatgataagaagaaaagacgtaaaatatcaaaggacatgagcaacagatataacaccctaacagtcttccccagcctgacacaggatcatcacaggccaacctgaaggactgtgtaagtagagttttttcagttcactcagaagagtaatcagctccacagagggagatccaatggaagctacctactcactcctgaaagcaaagtactagccttcttgcttcaggggagcacagaacttatcttgctaactgaaagctgggagccactggtgcctgactgtctagcactagccaccctgggcggagacctttctgaagtcatcctggagtgaaaaatagactcctcagaaacacaaatctgtaccattgacaggcatcagggacgacaggctggtggccaaggtcacgtgctgaatggaggtaggaggctctggctgtgactcatgggactctttactgctctcattacataatgtgaaccagatcctcatcttctcatcagataatgatctttgttctccagactaaaggggtgattacaatctgaagagctgattgtgtctcattacacttgtgataatatattcctgatgaccaaggctaaccaaggctattaacttgaaccttcaaataccaacagtcacaagttgtccctttgatatattcgcatctgttctgtgttgaattgaaaaaggttttcttgctacaaaatgtgtaaaggagaaaaagttaaaccagtacagaacagccagtgctgtttttttccaatccaggaaagcatcttaattcaattgaatgacttttagtacactgagatcttaacgtaaaaacaaaacaaaacaaaaaagcaaagtgattcataaatgtcacagcataaaaaggtccaaagccctcactttattgcttcctgatagtcttaagcgcttctcctctagcaatgttttcctctgtattataatcttaagaactataaccactaccttttggaatggaattggtttccttttaaaccactttcctctctttatgacgaaaaggaaatttgagtatctttctctacctccatttctacattgtcagttgtcaaaagaaagtgaacaaaaataaaagaactagatgacatgtgttctcagattcagagatgtactaataaagggatacacgtactattttgcaaatcctagaagactaatttctatcatgatcacaaaaaatctaagttggtagtctccaaaaatggattcatgaagaaaatcagaataatttatgagtgacaaatcaaactcaagagttacaaataggattcaggtaccagaattttcattccaccagcataagatggggctttacctgaccctgtccctgtccctgaagctgagtgaactgcagactaacggcacctctgtctgagtttcctgctcagatagcatattgcagtttaatttattttattttattttatttatttattttttttttttttttgagacagaatctcactctgtcacccagactggagtgcagtggcctgatctctgctcactgtaatctccgcctcccaggttcacgccattctcctgccccagcctcccgagtagctgggactgcagtcactcgccaccatgcccagctaatttttttgtatttttagtagagacggggtttcaccatgttagcaaggacagtctcaatctcctgactttgtgatccgcccgcctcggcctcccaaagtgctgggattacaggcatgagccaccgcgcccagccgcatattgcagtttatttctagagaaagcatcaggactaggaagcagtatgtcaacatgaatgggccagaacagagaagggttttaaactgcaatcaagcaatcttatagtaagaaattgtgagaattatttaaaaatgactattccatttgacttttcagccaaaccaggctctaaaattcccccaatctctcagaatattagaagctaaaacaaggacgtgtgtataaataaattaactgagagctttaaaaagatctggtgacaacatgaaaggaaggcttacgacccactaaaattttgaactgaaaagcagagaaatggttgttatttgactaaaacttacagaagacccttcttcttcggggaagcaggagtgagtcagcaggggacacattatggagaatctcaaatgcacaaagcactgagaggagaaagggatgaaaagaatttcaggacaatccagaggaggtgcttaaaaagaatcaagtctctgccaaagacagaaagagccagctctttgtttcagagaggcctgcagctacaggacttagattggggcataaattctaattaaagcaaatctttctagattccctgaagaatttccactcaccagcttcatctgtcagtgtggcttgagccacttgctacacagctcgacccagagctgctctgtccctggccatgccaaggaggaaactgtgtgtggtagccacactctccctacctgggaggtttatcctcttctgcaactggctgcttctgtaaagacaagcgtctgggtgcagatgagcaccaggatttgaccaaggaagaggaaggaggttaggaagcagagaacaaaacacaacaaaacaagaaaattaaaaactctaaccttcaagggatttcaaggagaaaacagaggaaaaaggacaagtagaaaaaaaggaaggcttctttgagcaggcagagcacaattaaggacacctgtgattttaggagctaacaaaaagcagatgtgtcatggcctcagactcccgtcccttcagcccagtcctcatgcagcctaactggaccccaaaccacaaaggggctggaggagaaaagggaggtctaagtcagcccagctgcaataacaaaggcagaaggctggaaccacaaaagcttttaaaaataaacattgtgattcaaggcaaggggggaaaaacagcactgagggaaacttcaagaagcactggctctcagcagacatcattttaaagaaccatttggaaattgccattcaatgaggtgtttaaatgacaacagagaggctgtcttacccaagtagaacaggatcaaacagagagatcagaagtaccctgccctgctcgcacttttctacagagcaactaaacttgcctttcatctctccaggaatactttctccatcatgaacgtaactaaagcctctaagacattgaaagatctggaattttcatactgttataccccctacacattctagatcgagcctagcaaattagcccaaatatgtatctatttcagagcttttaggaaaatagctagtctccctgtttgtactaaccacgtgctgcttctaaattcaatgtctgaatgtgcaaactatggcctagaacttcctaagatacttaaaagaaagaggaaacgtggtaaacctacaacacgcaaactctccttgaagaggacttctcaaaagctcctcagaggagtagaaatcgcaccatgatctaagttcaaaccctgtcaccaatttctacctgtgcagagtggatatgtatttctgttgttttttgttttgtaaaacttctctcagtttcttcttctgtaaaagagaggtaacagcaaccaggttgcaagtaaatgttgaggttccaacaatatgcataccaagttcctcactcaaaattgctcttaacccttcaatattattatcatcataacaaacaaatatttctgacaccaaagggctgatggttaagagtgttggaatggtctactctacgagcctgcatccatgactttacccatctgtgcctccttgcttaatataaaaaataaggtatgttagattaatttctttaaggcccatttgaggactaacaagtctagttgtctgggaatttgaattcttcctctgtattttacaactgtaaggattcatcctattgctattaggaaggtttttttcctccaaacaacttttcaaaaaaagaaaaattaaatacattaatttgatgccttttggggctacatgttttgaaagggtcacaggataagattttgatatgaggtacaaaaggaaagaaaaataattcttgaaaaaccagcatctctcctttttttttttttttttttttttttgagacagagtctcgctctgtcacccaggatggagtgcagtggcgccatctcggctcactgcaagctccgcctcccgggttcatgccattctcctgcctcagcctccccagtagctgggactacagccacccgccaacacgcccagctaattttttgtatttttagtagagacgggatctcaccgttttagccaggatggtctcgatctcctgacctcgtgatccgcccgcctcggcctcccaaagtgctgggattacaggcgtgagccaccgcgcctggcccagcatctctccttttatttaaggatgagacaaagccattatgtatcacaattgtgtaaaggcacaaagagctaatgacaaagggccttctttgttccctagtcatagcagttttgttctaaatcatcaagtctgctacctcctaaaaattgatctgatgaatctttcgctctttctcaagcttttgaaataatgtagaacccataaaccctaaactaagatgaacatttgccaatgacactccttcatcaaactttaagctgctcctcctcataagcacatcagcaacaaggcagttaaggtgattcagatagcaggcactcgcccatacgccacccagcacgccaaggcagcttttggtcagattgcccagcaagccacacaagatggtggcaaactgctctggggctgtgggagagagccaaacacagaagctccaagggtgagggagggaagactctacagaaaaccagggctccatgttcaaagctgagtttgctgtaaaatggagcacaggaaccctgaattgccatgaataacagtgccagctcctcggaacacgtatgagcatcaatttgggaggaacccaatgacaaacgacagatacaagtagttgagaggctcctaggcagggagtcccaacgatgtgcacattttacaatcagatttgtatcaaaggcatcctttaatgcccccagggacaactttcagcttcagttagaataaggtaagctgtgttgtaggaaaactgattcaagtagtcttggaagactcagccaataatttgatctattttcacaagaaaatatgaaccagaatgatttttatcaatgccagtggcaataaatagtgtacataatatgctatacgtagtatataaggttaatagctaatatcaaatctcaactttttaaaaaaagtcccataattacactattttctttaaaaattagaactgtttcctggaaagcctttgagggatcgtaatttaaacagattttaaggcagctaccctgatacctgcttcctcctgttcacactcctgcatgatcccttgagggtaggtgggacctgtgacttgtttctacaaatagaacacagcaaagataatatatatgcatgattaggtcgttatattatataaaattgcagcacccatcttggcagcttccctttctccctggctggcttttggattcaaacagcaatgctggagaaatccatacgacaaggaagtgcaggcagcctctagagctgaaaaagcctccagcaagaaaatgaggccctcagtcctacaaccacaaggaaacaaattctgcctacagcccaagtgaaccctgaagcagatccttccccagctgagcattcagatgagatccaagccccagtcaactgtccttgattgcagcctcggagaaaactgaacaaagccagatctagactcccaatccatagaaatgatgacataatataatgtatgttcttttaagtcactaagtttgttgtaatatttttatgagttaatattagtagataactgataaagatcattaaatctcaagttgttaaatacagagaaagataaataattttatttaaaataaatctatatgattgtttattcaatggaactggtctataataaaatataaatgtatattttaaatgcctgattttattaagcttctttttaattacagcacaaaatcaggcattgcagataactgattccttttccatttacaattctgcagtggttctaaagaaagcaaggtcataatcaaataagagaaataaaataacatcaaaatatcagcatttgatcattagttaccatggagagttcagcttttaaattgacctacaatgattagacagtgccacatcatctactgtcaagatttgttttcaaatttttggtagctcatataaaacacctctgagaatactcagtaggagatttttattctgattttatcaataatacaaatgaagaatctgattgttgaccaggcatcagtaaagtactgtattactaaattgtgtaatgataggagttcatgggttagaacaactgtcagtgagttcacagaaatacatttaatattgtcataaatatagactttaaaaatacgtagaacaaaacagttttaacaaaacagaaaatattcaagaaaagatgcaagtctatttcaacagattaagtatatacccaaaacatgaaacagcctatgcagatactaaagtatttttaaaatcatatttatgaattaatttaaacataattagtataagtatattatttcaatctgtctactattaaagattaaaaaagtaataaaatataatatgctagatgttcaagtagcaaaatctactcactcgaagcaaaacgattttgattacttctctactttttgggaaaacagagaaaaatgattttcagtcttgaaatgtttattaacttgaaactgaaagaaacattccaatttccatttttgaactcccagatattaagggattgctatcttctaaaattaattatccttttaatgatagtatatgacacaatcaaatgaaattatttgctatattaaagccatgtattcccttactaagaagcacctatgataacctatgtcattatgttttgaaatttttcagcttatttattaccttaagacttaaatgtagttaagcaagtatctattttgttatttttatgaagagtaagctgacaatttttccctcaatttgctatcttagatttccctaaaccttgcttagcaagtactctatcacttctcttggtcttaactccaaagatggatgagaaaacttgagtatagacaggctcactgtaatttacatcattcatggaaacgcctctttccttggtcgttggcttttctcaaacatacacttagcatagagatttcctagcatggaaatgatggttaaaagctcatgtgtgaagatcagctaggaaactattgtggcaaagcaggaatatggaaaagctgaataccaggtattatttcagatttggttttgttctcctcaaggtgtcttacagagaatgctcactgaatcttccagggtatcttaaaggcatggaagattataacttaggaaaaagcaaatataatgaccaagagctgacaccaaatggaaatgcttacagcaatagcagtcagctgcctgaaaacctcagcttgcccctgttattactaatggcccaggtaaggcaaagtccttagttagaaactgaaaaatcaattattggctgccaagtactggttgacctgacaatagaatggcatagagaatgatatttttccaagtagaggcccatcatcttctgattttttacagtagaatcaaatgtggggtcaggaacacctgctcagaaacaccaccgtgatatcactccagcacaccttgctacctctcttccctgaaggatgcatctgtaagaagcggtgtaattagagatacttcactgcacaatcatatgtggaggaaacagcaatagtatagtcctgcagagacaactaagtaagagacaggcaacgattcttttatttaaaaaactatgagtatagtctaaatagtttggtgtgtttgcacatatgtatgaacgtactccacagatgcttggcatttatcattctgttacctaggaggggacttccactctgtcctataatctccaagttagcctttctagccagaaaaaatcagggatcaaagagacactgaaactgtggcaacataaaaggcagaaacacaaatgtcttgatcattggcctacatccattgttaggatggtggcactgctatctacaaccttggcttaaagacttcaatcccaagactttctcatactcgagttctagaagtatctctatcccaaacctaaacaaaatgttcaccaagtcttccccaaaattgcctcttacatgagcacactttttaaaagaagacatacacgcagccaaaaagcacatgagaaagatctcaacatcactgatcgttgaagaaatgcaaaccaaaaccacaatgagataccacctcacaccactcagaatggctattattaaaaagtcaaaaaataacagatgctggcgtggttacagagaaaaccaatgcttagacactgttggtgggagtgtaaattagttcagccattgtggaaagcagtgtggtgattccccaaatagctaaaaacagaattaccattcaactcagcaatcccattaattgatacacatacccaaaggaatatatatcattctaccataaagacacacgtgtgtgtatgttcattgcagcactattcacaatagcaaagacatggaatcaacctaaatgcccagcaattttagactggataaagaaaatgtggtagatatatagcatggaatactatgcagccattaaaaaaatcaagatcatgtcctttgcaggaacatggatggagctggaggccattatccttagcaaaccaacacaggaatagaaaaccaaataccgcattttctcacttataagtgggagctaaatagtgagaacacatggacacaaagagaagaataacagatactggggcctatcagagggtgcagagggaaaggagacaggggatctgaaaaaataactaaggagtactaggcttaatacctgggcaatgaaataatctgtacaatgaacccccgtgacataagtttacctatataacaaacccgcacatgtatccctgaacttaaaataaaagttaaaaaaaaaaaaaaagaattttcaagaactccctgggacatgaacaataaaaatgccttttgtggatgcttaaaaaaagaaaaaagaaaagaacaataaggatgcaacttgcatccaagctctgataaaagactcatcttgtgggaaaccatcttaatttatgttgagcaagaaagtcttattggggaaccacctagtctgaagaaaaacagtgaaagcgttctcaagtgcgaagtatggattctgacaacgaattctaaataaaagatcattgaaacaactaaagggagagagggaggttttgtgataaactgcatttgacagagttcctttagatctagaaaaaacaaaaccctccatacacttatggtatctcctaaatattaaagtcttctcgagggaagggcaggaggtcaggacaatatcatgaacaattaagtattattttccaggcaagttagttttttttttatttttctaaactgtcagtggcaatcattctctaaagaaaaggggcctttattctgagcctgagtaaacatagtgaagttgctatagaaataaagaagccaaaatctaaaccataaaaaaactctggtgctaaaaatggatactctcattttgctgcaaaattataggttcagcaggtgctccaagccactgagacctctgctgccaacgtggggctttcctctgtccctaagcagctcactgtcttccaaggaatctaagtcatagaaatggcaaggtgtattgaatattctggtagtagatgctagaccaccaaagttgtttcaaatcaacagctgtaaccatcagacttagcctggaatgtgttctcatctggctctgttgaaaaagtactccacacccccctgaaggtgttttcactgtgtctgcgttgtggctttgggggaacattatctatgttgttactggttgataagctacactctaaaggcgaaatccaaaggagtcttttcaaatctgtgatgctgtattcagattttctaaacctcgacactgttgacatctggggccagataatcctctgtcatgggggagctggtctgtgcatggtgagatcctgagcagcgttcctggtctctacccacaagacaccagcagcagctctccccaccctgaatgacaacaccaaaaatatcattagacattgccaaatgtcccctaggaaacaaagttgcccctgattaaaagccactgtgttagatccatttaatagtataactttcaaatgaggccttgaaaagtatagggtaaatctatttgcttccctatttggaagataaatagttacaggaaaaaaacaggagccagaataatgtctaaactcccatgtcttactaagagtatgcatacatacacacgtttccatcggcttagaaaatttctggaaagaactgttaagaagatgttaatagtgcttgcctctggagagtgaactgtttacactttcctactgtttgaacagtttactcacgtaccccttttcaatcatgttttaaataattttaataacatatttttaagtcacattcaatatattttttagaaagcaataggtgttgattttcagtcaaattagagttaaaatggggttttccaatccatttgaaattccaaagcccccgttgagggagctgggccccaggcttggatgccatctgccggcagcagccccagccctggcatggaagcttgtagaccatcacagcctcctttgagtggaaaacagaataaaatggaagaaagtgccacaaaagcccacaaaggattgctcgctgtgtggtcatcgttctctggaataagatccttagtcctaaagcactcaggtctcttttggagcagatgccagtggcaagtctcacagcggtctgcaggcaccatgaagggaggtctgagttttctgtccagcacgatggtctgcaagcgtgtgcggacctgtggctcgtgtttcctagtaatccccaaaaatgcttccttgaaatgcttctttaaggagccccaactacagtcacctggaacgagctgtaaaactgtgtaacatgaggtcatttcattctggattctggatcctggatccccaacagaatcaataagaaaatgtcaaaatgctgggccccaggcccgctcctgacttgctgaatcaggacctctgggtatgggaacacagtctcattgttaacatgttaccagatgatccctgtgaaactttctgcttatctgtgggtcagtattcaagagtttccgtaattttcaagttgaaataagaatcttatgtaaaatatagtgactttcccaagggctgaaacttgcagattttcccaaaagagactccatgtctcaatcttgaaatggttgggagaaatttatgcatcaaaaaggagcattttaaagacttatcgtgtgccaagatatattaatacagtcagccctccatatccattggttccatatctgtggattcaacaatcagggatggaaagtaattgggataaagaaattccacaagtgctgtaaggcaaaacttgaatctactgtgtgccaaatactatgttgaatccaagcaaatgaaatgatgtataggcattacataggatactacaagtaatccagagatcatttaaagtatatgggaagatgctcacaggttatatggtaacactacaccattttctgtcagagacttgagcatccacagagtttggtatccacaggttcttggaaccaatcccccatggatacagaggatgactttattctccatctatattccactgggctgactgccatgtagttatttcattactttttactgttttgggtccttgggaaaaacaacatgtcatgcccagaatgataaggtgatatctgaacaggttccccaaacacaaagacgagcatgcatggcactgaagtgagagagtgagaagagaacttcagagagacgtccagtgttgctaaccacagaggacccagtggagaattcagagagaaattacaagttaaaccaatgctaattattgaccaagaaggccttaacatttctttctctcgagggtaatgtcaagccagcaaggtctgagagttgggggtgcaagtatctgagtagctgtgcacacagatacctgggtaccaatgtggagatcactgggaaacaggattaaatcagtaggaataagaaaagtccccaggcacaccggggactgttgtggggtgaggggaagggggagggatagcattaggagatatacctaatgctaaatgacgagttactgggtgcagcacaccaacatggcacatgtatacatatgtaacaaacctgcacgttgtgcacatgtaccctaaaactcaaagtataataataataaaatttaaaaaaaaaaaaaaaagaaaagtccccaggcagtgaaggaatcatgcctcacactatcaacatggttgaagaggatgggaaagaagggctattgaagggctactgagcagtgaagttatttatgagatagaattttgtggctattagagagggggtttgaaaaacaaaagggtaaaacttagaatgattctgagatttctagtttgggaaactagattcgtgtatttacagacaaagataaggaaatccaattaccaaaaagtcattaaatgaatacaatctgctcttacattactataaagttattattttccatgtttatcataaatatttcagagctaattatctgggcttggtttcacttgtgtacttggctgatttttctcattcctcctcttcccactcagcattaaataattgggatccactcccaatgagtgtttctgaaatactcttcaaagtcattgccaagggagagattgccttttcggattggtgtgtctcagatttatcacaagagtgggcagatgtgagggaaaaggagaatgagctttggcagtaacaatgcagagaagagttttgttattcttagtgagcatcaaaaggcagaaaggcatcctcataaatcattgtccaaaccaatagccttccccagaaacaaagttttggcccttctcatcttttgagctaaaagaatcagatgccaagaacagggagatgagatgcatgaattgttctttttttttttgagacggagtctcgctctgttgcccaggctggagtgcagtggtgtgatcttggctcactacaacctccacctcctgggttcaagcaattctcctgcctcagcctcctgaatagctgggattacaggcatcaaccactgtgcctggctaatttttgtatttttagtagggaacggggtttcaccatcttggccaggcttgtcttgaactgttgacctcatgatccacccgcctcagcctcccaaagtgctgggattacaaacgtgagccaccgcgcccggctgcatgaactgttctgaggcctgatgagcctttgcttattcccagattagaactccaggcaccttccacttccatgggtgagaacttcagggtatttactggaggactccaaacttctgtttgtccatgccatgttgaggaacacctcagctggccaagtgggtatacctggaaaaagctctttgtttcctggcacagactagaggactgtaagcatgggtggctttccaactggacagaatctggtaaacaagcaccaggagcctctaagccaggatcaagctgaggcaggtagcagcagctctgtgcctggaggtgggagccggggtgggtggaaggtctaggcaggcctaagcccgccctggcccagcgtgggtctggcgtcctgcctgcgggaggctggttccttgtgcagaattactaaatgctacaaataaggaaacactgcagatgaaagttttaaaggtttattagtaataacaccattcggggcactaaaacttcaaagtcctttgactagcagagtctaactaatctttacaacaccccagtgggctaggtaagcaaataaatattattatccctattatgtggagcacagagagctgtaagaggacttgctcagggctacaggaagatcagcgttactcacatcttggtaactaccaagtccagactcagaacagcaggctgccccttactccactgactcatgctgccacaaaaacggcagggagggcccgggaaagagactctcatgattcagaacagaacttgtgacagaagcaggcattgttggtttttttcttgttgcagctttaataacagtaaatgacagtaattttgcccaattagaaatgtctgacttgagatgttaggcagacgccttcattactggaacgtctactgtaggattttgacaaatcttacccagagtgggaccagcttccctagggctcctcctgaatggtgactcctacatactaaggctttccaggttaacctaaaaagtgtaggtttgcgaactaaacagtccttagtgggggttttaatccttcttttaataaattacaatatgtttctaaataaagaaattttagaaaatatgaaatggtaaaaagaaaatggtagtatgtgaactcttcctagtactataagtgatttctggtaacacttgggggtgtgtcctacatttaaactatataaaattcaggctgtctatatttcttcaaatccttgaataccatccaaaaatctgatttaaatggctacatagcaacccgtcaaatggtggcatccatttactcggccaatctccagctacatgatagtttggggtttcgaattactagtatcacaacaccagataaacatcccttttcatgaatatttctattaatttcaaaattttagaagaagagccactgagtaaatggattcatacatatttaaagcatttcatacctaccgtcacattgttctccataatattctatcactttccactttcgtatgttgtaagaggttcatttttctgagcctccaaaatttctatgttggtgaggcttaagagtagcaatggatttttttgttttgttttgttttgttttgtttttgagatgaagtctctctctgtcgcccagactggagagcagtggcacaatctcggctcactgcaacctccgcctcccagattcaagcgattctcctgcctcagcctcctgagtagctgggactacaggcgcccgccaccactcctggctaatctttgtatttttagtagagatggggtttcaccgtattgttcaggctggtcttgaactcctgaccttgtgatccacctgcctcggcctcccaaagtgctgggattacaggcatgagccaccacacccggccagcaatggattttaattaatagctagtgaatttagcataaggtcatgcttaaagcctagattttagttatgcggaatgtttaattggggtagtgagagagggctaccagaaaacagagaaaggtaatgtttacccatctccaaaatagccaccaccttctattaagcaaccataaaaacaactcatgtacaagatttttgcaagcaaggtgtccccatttcacatttgagaaaaatgaggctcaaaaagattcactcactcgctccaggtcattgatcctaggtttggagccaggataccggccctagggcatctgttccatcccactgggatatcaatggaaactaaaagtgctggagaccctgagcagggtagacaagagaatgtttttgttcatgattttttttaatcttcttcttccaaattataaatggcagaaatgtttttgatgctagcttcaaggcaaccttcagcatgcaagaacccccagcaggcttgcattaaaagcattttgtaagaaccttgggtatttggagtacttttacttaaatcttgaggaacacatgtttaagagggcaagctctgagccagacaaatgtggcttttattcctgagtctgcaatttaggatgtgtacaactttgagcaggccccaaatggaaaatccaatcttcatttgtgaaatgaaaaagagggggaattaaaagagacagtacatgcagaagggtaattccaacgtctggacatggtaagtcctcaagaaatggcagcttttaagatgagcatgttagggggggttccactatttcaaacaaggtcacaaagaggtagcataggtttttgacttacaaggagagagaaggtaatctcaactccacaggctggaaactctattcccttgatgttagggtgtgtccccaggttgcacaaagaagtttcagaagtgggaaattccttgttcctatagtgtgtgcttcaaacaaattatgcagcaatactgtacaatgactgagatttggctctggggaaataaacaaaattagattccacaaccaactctgtccaggaagtaccactgcctcttgagtccttaccttcagtaagctccatatgtaaaataaagatcattgaatttccagctcatgtgagaagtgactgagacaacatgacatatgcaaaggtaagggtaacaatgtctatcacataaaacaaaaaactcatacaggaattacagtatccatgagcgctgtccagtcttcctcccacttcttcacctcttcaaagttggccatagtcccaggatttctctggccaatgagatgtaaatagaaggaaaccatgcctcctctggatgaaagccttcccagggtcaatggaccatatgccatgttctcttatttccctaacagtgaccagcaactctcaagatgacagccaccccagaaatcagcctgcctcccaaagacagacctcttcaaagagcacctccagcaagcccagatgcacatggagcacaaatgagaaatgaacatttgttgtttgaagctgcagagatttaggggttgttggttacagcaacctggcccatagaaactgatgcagattttaatatgagtagcttattagtccattccatagagctggaaaaagcgatcctagttattttttatcaaaacattaataataattatgataaggagggctttctcaagtagagtaggtagctgaaaagaaaaacaatgtaatgttgaagacgaaaccctcattcaggaccctctgagaactgactctgctttctgccttggaaaaggtcagggctcactgacatagagtctaatttaggaaccaggagaacccaattcccttcacatccgtatatcacacacctaagtctacaagaacggtaatatgagtgtcctgaggatgaacgagtgatggggtctcaacatgttggggctgatgtctcagttcctacaggacccttcttgggagtgtccctgaaatactgcctaactgggtatctgaagaggaacgaggcaaaggaaagctgcccagagatagcctaaaattgccttccagaggtttctgtattctaattgtattctgtattctaattctctaattgagtgagttaattagagagagaatggtgtggcccttcctaccaatacataatccaccagaaagactggaagtttttcagtaccagcataagtaaggataggaatgcttgatttaagactagaaataacttacgacaattaaaaaaacatttttagcaaagtaacccgtccgattagaaactggtttgttagaaacagtagcaaagagagtttttaaatatccaaactatgcatcctaaataagtttataagtcaatgtttgttaagttgagtaactgttgctattaacaatctttgcaaccaataagtctgcatgtaccccttttaacaagattcattaaatacctagctaaacgatacagctaaacgatacaagcaaactcattgttcaaatttaaatgcaaactcattgctcaaaattaaatgctctgtggtatgcttttattcccaatttttcttgaaggaagaatgcagaaaagtagaaaaagtaacaacctgctcctcttagaaaaatgattgaatgctttatacagtgtaagatctataatgcaaattattaagaatctggctacatttttttattatactttaagttttagggtacatgtgcacaacgtgcaggtttgttacatatgtatacatgtgccatgttggtgtgctgcacccattaactcttcatttaacattagaaaaaagctattgactattgactcattgcttctatctctcaaatacacacaaccaatcatgttttctgacagcatgcatcctctgggaaatatttcctccacctcttctctaaaacttggcagtgtgaggttttgctttgcctttggtttttcttctatctgcctcatgacacttttgagcataagaaagacatcatctagtgccctggaagatgctttgttttgattcttgttcttttatggcaccctctgatagcattacctgactttggaaatcaattctgtgctgtgagaataaggtttgaaatgaaaacttcctgccttgtgttgaaaggacagagttagttttattgaggctagaaagtatttttccctgtattgttctatagacacagaaacaatccttagctcagtctggggcaaaagccaaagaaattgtctaaaatggcagatcctgaaggaggcttgggggttgggaggtgatgaggaagcagtcaagaaaactgtataataataattttgttcacttccagatagtctcctaatgttttcatagatctacttttcttcattgtgcaagctgcatatgtccactgtaaaagttttagaaaaatgtaataaaagaaagggaaaaaagcattcactatctgagtatctacagataatcatcactatcattttgatgcatttctttctaatctttattcaaaattattagaagtatatataaaaatatataaaatacatatacttatatagaattagtatttattgaataagttatgtataggatatatttctctgcatataaagtgaaatcctttaaaagcagaattttaacaactgcataatattcatgtcatgtacgtagcattattcatttcatcatttccttaccggtggccatttctttgccccatattttaagttgttcattcttttttctgtattttgtttatttacatatgtaccctaaaacttaaagtataataataacaaaataaaatatatatatatatatataatgcccacaaaataaaggaactaagtcataaatatgcatatgatttacataaaggagctaaaataagaaaaaaaaaaagaatgataaaagtcagcagggaaaagaactaccaaatcacctagtcaagtaaatgatttacaataacaaaaacaaacttaaaaactctacttgtaacaattttactggtgactaatacttctttaattaataaaacctattggctgcatatggcaatcagtggtaaaaaaaaaaaaaaaaaaaaagactaccaaccaaccaataagcccatgtagaccctggttctgtgaccctggttctgactctccaggaacagccaccggggatcaggctaccaagacgaaggcagagagcaggcagggtatgtagattttaccccaaaattcaggccaaacctagggctcaatatattcactggggagaggaataaggaaggagagagaggaggaaagaaggagggaaggagctgaagaggaggggctggggaggagtaaaggagaagagaaagaaacaggctcagggatatgggcttagggaacgtggtgtgcatggccatgggtggactggcagaagggcttctggaaaaactcagccctgtaaactggcagagaagggcacacatgcatcagcacgaggataccaggcatgaatatccaagtgctgcagaagccatgtgttctcatgagctggagggaggggagcagatgagcagcacagcagtccaaatgctgaaagagcagagctgtgaatcagtgatcaaaagacagggtgaccacatggagtccaaagatgctggtgagaagcaagatcatacaacagataggaatggaatgcccactccacaacatatggggcatgtaagatacatcatggacgtctacccacaaaaagcgatgtcaaatgagttttttttaaatattagaaagacggtgaagagtataataaaggaggggctaataaaaggcaaggatgctgacagaaagaagtcctctccaaggtgaagaattccgtccgtcagagctgatgatcagattgatcagtgagagaaaggatcttacgtggagtccgagcatcccaaagaaggccactcccgtacacccagctgaggccaggtgcaaatgtgatgtgtggggtgggggtgtgcctgaagccaaggctaacccaaaacatctgctggcttaaagggattctgggggagggctcagacacacatggggaaaccagctgtgagaggcatgaatcaaagaacagagccttcccaccaggaaacaggagtctggcttgaaaaagacgcaagagtaaataggcacatgtgagaagcatgcttaaaaaaaaaaaaatagggcattctggtatttcatctgaaagagtctacacatgttttaaagatttatccattcactaagaaattgcaagagaaacacccaccacgtgcaaggcacagcggcatgcatctttttctagctcaaagtgaattgaatgtgcccgtgattgcagaatcatttccattgtcagagtagaaatggctgcttccactctgtatggtggtaactcagtgaaacttactgccacctacatggccccatgtcatccagctctacccacctctcctgcctcaccccctcgcccgagacactctggccataccagcttacaccagccaaccctcaagggacattggtttctgaaacaggtgagccttttcctgcctctgggacttcacgtgttggaacccacctccattcttgtacttttggttccttcttattcttcatgtttgcttttatttacttatttatttagaaaccgagcctcactgtcacccaggctggagtgcagtggcacgatctcagctcactgcaacctccaccttccaggttcaagtgattgtcctgcctcagcctcccgactagctggggttatagacatgcaccacctactttcgtatttttaggagagactgagtttcgccatgttggccaggctggtctcgaactcctgacctcaggtgatctgcccgccttggcctcccaaagtgctgggattacaggtgtgagccaccacacctgctctacatctgcttttaaatgtcatggcctcacagaggcctttgtggtccaccgtgtcaaaatcttcaccatgcctattctcccatcaccctcatctcaagtttaattatgtaccacagtctttgttttcttatttgttgtctattgccttggttagattttccaaagaaaggaccgtgtccttcttagtcatgggtgtctgtcaagtagtggaggctctgtgaatacattctctaattttgagcaggtcaaagcaggacaaacacagaatgtttaatgaaaaggcagcctttaaagtaacatttattttccatttcataaaagttttcaaatgattttacaaatatgcaagaaaaattcatctgcataatacctagtggcattatctatattataacctaattgtcctgagcaacaaagtaactaaggaccccaaaatgaaaaataaagttgatttagccagttggtattgttaaaagtttgactggaagctactctatagcaggaaaaaagagtctcattcatatttgtattatcagtgccaagcaaagaacctggcaattaataagtgctccattaatgtgattttgattaaaagtgttcacgttttaaactaacatatggcagttatctttaaaactatagaatgacacaggtggaaagaaaatctcccttccattcccaaacttcaactcattttacagaggtagctaatgagaaaaagtcaatgtatattcttcgaaacatatccatgcattaatgatcaaaaatacctatgcaaggagatattaggctatacatgctgtttaacacctttcttcattcacccttcattcacatataatagatatttccatgtttgcaaaaatagatacatcattctatgtaaaggccgtacattactctgtgctttatttaaccaggtcacttctgtggacatttaaggttttttccacgattaaaaataaaaaaagcaatgaacatctacaattgtgtaattaggtggacataaatacaagataaatccccagaagtggaagcatcagatcaattaatgttgatagaaatttcctaaagcaccaaacagctattatagttacatcaacccttgcacatgttgggggtttactttttttttttaatctttaccaagctaataggtgaaaaatagttgatagtttacatttctttcattctgagtgaagctgaacagcttttcatactgttagctgcctttttggtttcttgataaaagctaaaggagactgatgcctccatgccaggtaccaggagggttatggcaagagcaacaaccctctgaagacaggctggatggagtcatgattcccatccacacagagctcaaaccaccctgggctctgaatctccagcccaattgcctaacgcatctctcaccttacccacacttctgcacactatgccttattattttttaaatgcctattcttcatttcaggtgacatacttttccatcatctttaccacaacatctactaaggcaaaataaaaatacccattgccattagaaaacagcagaactgtaccagatttggtggctcatatctgtcatcccagcagtttgggaggccaaggtaagaggacacatcacctgcggccaggaatttgagactagcctaggcaacatagcaagaccatgtctttacaaaactaaaaaaaaaaaaatagccatgcatggtaatatgatttggctctgtatccctgcccaaatctcatctcgaagtttaatccccatatatcaagggagggaggaacctggtaggagatgattggatcctgggaacagtttccccatgctgttctcatgatataatgatttaaaagtgtgattctttctccttctcattctctctctctctctctctcaccaccatgtaagacgtgcctcttttccccttcatcttctgctgtgactgtaagtttcatgaggcctcaccagccatgcagaactgtgagtaaattaaatctcttttctttataaattaccaaatgtcagatagttctttatagcagtgaaaacaggaatgtaatgtaatacaggaaatcagtaccagaagtgggacattgctataaatgtacctaaaaatgtggaagcaacctttgaactgcgtaatgggcagaggttggaatagtctggagggctcagaagacaggaagatgggggaaagtttggaacttcctagagacttgttgaatgattttgaccaaaatgctgatagtgatgttgataatcaagtccaggctgaggtgctctcagatggagatgaggaacttattaggaattggagcaaaggtcactcttgctatgctttagcaaagagactggtggcattgtgcccctgctctagggacctggggaactttgaactcgagagagatgatttagggtatctgtcagaagaaagttctaagcaacaaattactcaagatgtgacctgggtgctcctaacagcatatagtcatatgtgttcacaaagagatgatctaaaattggaacttatatttaaaagggaagcagaacataaaagattggaaaatttgcagtctgaccatgcagtagaaaagaaaaaaacatttcatagggagaaattcaagccagctgcagaaatttgcataagcaacaatggggaaaacgtctccaaggcatttcaaagatctacatggcaggccctcctatcacaggcctggaggcccatgagggaccttcctgggcccagggtccctgtgctctgtgcagccttgggacatgatgcgctgtatcccagccactccagctacagacatgactataggggccaaggtacagcttgggctattgcttcagaaggtagcttccttctgccaagaagacttggcagcttccacgtggtgttcagccttcaggtgcacagaaaacaagagttgagctttgagaacctccgcatgtatttcagaggatgtatggaaacacctggatgtcgaggcataagtcagctgcaggggcagagccctcatggagaacctctactcaggcaatgcagaggggcagtgtggggttggaggccccatacagaatccccgctgggcattgcctagtagagctgtgagaagagggccaccattctccagaccccagaatggtagatccaatgacagcttgcactgtgcacctggaaaagctgcaagaactcaatgtcagctggtgaatgcagctacaggggctgtaccctgcagaaccacagggtcaaggctgcccaagggcttgagagtccaccccttgcatcagtgtgccctggatgtgagacatggagtcaaaggagattattttggagctttaagatttaatggctttccttctcagttttggacttgcatgggccctgtagcccttggttttggccaagttctcccttttggaatgggagcatttactcgatgcctgtactcccattgtatcttggaagtaactaaattgcttttgattttacaggctcataggtggaagagacttcccttgtctcaaatgagactttggacttatacttttgagttaatactggaatgagttaagactttgaggagaggcataattgtgttttgaaaagtgagaaagacatgagatttaggaggggccagggtgggatgatatggcttggctctgtgtccccacccaaatctcatctcgaattgtaatccccacatgttgagggaggaacctggtgagagggattgaatcattggggtagtttcccccattgtattctcatgatagtgagttctcacaagatctgatggcataagtgtggcatttgtctctctttcctgccacctacatgtacgacgtgcctcacttccccttcaccttccaccatgattgtaaatttcctgagtccccctccagccattcagaactgtgagccaagtaaatctcttttatttatcaattacccagtctcagatagtttttttaatagcagtatgaaaacagactaatctacatggtgacacatggctgtattagtctagctactcaggaggctgaagcaggaggatcacttgagcctaggagtttgaggtcagtgagctatgattgtgctatggcacttcagcctgggtaacctagtgtgaccatgtctatgaaaaaaaaaaaaacttaataaagaaaaaagcagaacctttctacaataagcgatggcgggatagtgggcaaagcaaagccttggacgtgggctctgcagcttataagtgttccatctggagtgtcggagcgtcagcttcctcatctgtaacatctaccctgtaggaatgttgtgtgggtagaaagaatgtatgtacagtgccctggacttaatacaatccagaaacggaagtggttattattggcaacatgatgtgggtaagatttgtggtaaggaataaaatcttcttcgggtattaattctcccttcataccaggatttcagaacaagggaaatctttgctatttccccatcaagaatcatgtatacaacctgttcgctggagaggcaccttgggctggcaggtactccggagatggccactccctcactagcatcaccagagggtgatgataagagaaggctacagggagaggaggttgatgatcacacacatcacctctaaggtggtggaggtaattcatcagtataacaggcactcacaaaatacttcttgaaagaatgaatgaactgcccacctaagaaatcctctgataaatgttcttttttttctcctcgtttaaaccaagagtactccaccacagcattgctgacctttgggaccagattattctctgttgctgggggctgccctgtgcactgtaggacattcaccagcatccttggcctctgcacattcgacacgaatagcacacacacaagggcaagttgtgacaactaaaccatctctagacattgccagatgtcccctgagggcaaaatcacttccagtaaaaaccaatggttcagactataggaaagcaaaaaaatatatttttgaggctaaaaataacttaactttttactatgtccctgaatccaaagctgttttgaaggcttagcaaataatatagctataacttagcatagcaagtccttagagcaatttacaactgactggagaatattaaccgcctaaggcaaatcagtccttaactgctgctattctgggggtggggagggggacacagcattaataattcaataaaggaaaggctgcaggcaatgagaccctagagttatttatttagccaattagattcgtttttggtggcaaccctgcctttgtgagtatgaatacgccatgtctattcttcaattaaccaggaaaattgtacctcacaaatctgctcttactgcctttcagctggaggatgtgcagttcaagtggtcctggagccttcagaggagggaaacaggctgggaacattcatcacttacacgtgtgcctcacacagaacagatccatgcactgggggtgtgcaaattagaggtgtcagcatcagtcctcactgttcctgccctaactttccagccctaatccagagcaagacagggatgaattatatcaggtaaaatttagagccatggacacatagatatgctcagtttattactgttagtgataaacaatcctactttaaccactaagagactagaaaacatggttttttgtttttttggttttttggtttttttgagatagagtctcattctgttgcccaggttggagtgcagtggcatgatcttggctcactgcaacctctgccacccaagttcaagcgattctcctgcctcagcctcctgagtagcggggattacaggtgcataactaccacgcccagctaatttttgtatttttagtagagatggagtttcaccatgttggccaggctggtcttgaactcctgacctgaagtgatctgcccactttggcctccaaagtgctgggattataggcatgagccaccatgcccggcccaaaacatagtattaaatatacgtctggtgaagcaaatccaagagctttcctgttttaactttgctcacaatttaggctgcaggaactgctggaggtccctgaagtggacctattttggtggcttattttggtctagatcacaatgtggaaggtgtccctatcactctcttgtggtcaataggaggtcaactcaaagccctacagactacagtagctaatggggattatttttttaaaatcatcaggaagaagaatatataaaccaacatagtcctgttcactgggacaaaccattagaaattctagagatttctccataagctgttagagattttctttttccttgggtatttataaccttagcacttccatttctaccatatattttacttccttttccctttcttgctctcctttttcttttttggttccacttatttgtttagagcccagattctctaataattacaggtggcggcaagctgtgaggcttcacaaaaagtcagatacttagaccaggaaatcacagaaaggccactgacaagattccaatgtgaagatgcccctgaccattgacttgtcctcgatatctaaacaaagagcacatccctaacagggggaccaagatttcttatgcacacacacatctgtctgtcgcaggccttggagacctgggatcagtcagatccccaatgagagcacaaaatggaaatcacatctccaaaccacttttgtttcactaaaatcaaactgatgtttcagtcaacaaaacataaagagtttcagtgcctcatgaaatttcactgacccaaaaattacttttgtcaacccaaacatagctttcttttctcatttaatgtgatcgcagttgtgctcaccaagtccagttgagtacagagtgggatgcccgtgaatatgccaggagctgagagctgaacagtacctgacatttcacccatttaaattatagacttttcctactccagaagattcaggacatctatagcatgtgtccaaatgtggcacaaaggaaaaatatcttattaactcagcacaattatggggtctgagatcagaggaactggaggccttgtaatgtagagcagcagcttacaggaatggaactcagagcaaataaattttgattgagacaggaagaaaaaggaaaaacacaagacattacctagagtgagcatacctaaaggccaagattctgggtgagtggaaggtgggaggaaaaacagcccctctcaggcatacaataacaggtgatgtggataccactcactggaagggaactggggatgcccagtggtgtgccagccaatgtttaatgaccacccatcggaagaagcccttacctgtggtgtgtgccaatttccatggtgtaaacactcccaccatagcctacattaagctactatcacaatgtcactgaacacagagacagggagacacgcacacaattggctctcacaaggtaggaggaacagctccagcacagagcacccctggcacaggaagtggaactgaaaagaagctgggcaggggcctggtgcccacttcttttgacaggcgatttgtgtgtatggggcttctgtcttgacacagctggactttcctgatcatttagtctcagaaactgaatggagattgtttcctttgtcactcccaattctgctctgtgaaattcttaggaatttaaaaattcatgatgagcacatagtaacttaaattcaaacatcaaaggactgctcagttttttctcctgttgtgaccttattgtggtaaatattgcattaaattgccatgccaataattgagattcagaagcactttagttttgaagaaatttgctgttcatggcatttagtgacaaagattttcaccttctcattccctatctctcttcattctccttctaccactccctctctctcattttctctcccataatgttctgtctttggggctgtctccaaccctttcccatttatctttccaagtatctctatatatctctttctcaacttctttccccttaccccctctccctcactcttctctcaacttctcagtaagggaaagatttctcgtcctatctgcataatgtgtctgacaattccagtctctgtttgctaatcatgcttaaaagaatgacataccagaatgtagagacaacaggaagaggtaaactaagggaagcactgaaaaataccaggcataacaaaagcctgaacaagctctgcatgcataaagaggtactatgcattaggcatatggacttcacttgagattatgtaccataaacaagtacaacatgacaaaaaagaacatacagacgtggagtaaactactgaccacttaaagctggctgaaaatcccacaatacggatcctgagttttacttcccttttcttctctggttccccttaccctggtacctgccaaccgagcctttgatttaaacatttttatatatcaaaagatacagaagaaaaaagtaatttagatgtaaacattgaaacagcttatgttacaaaatgagtgcagttttaaaaaataaatacgcaaagccttggggggaggagaaaaaaacagctttgaagggaatagacaaataaaaagcccactaaagacacagatcattccagaggtgattccttctttctgcctgacacaggctgtgtggccaacatatgtatcaacagacaggaagtaacagaactccaaaccagacaggcgctgggagctcattctatattcacagaatcatattcgggaaggcagggtcccaggaagtactaaatcaaatcctgccacttcacaataacaaggaaaggataaaatgaattcttgatagccacagatttttcagaggaaaaaagaacagattttcaacttgaaaccattacattttagacaactttttaaaaagcttgaatttcaaggattagggcaaagtacgtgctctgtgttcctctgctaactgaaactgaaggctgtgttcccagttcttacagtcatttgacaaatacatcaacaagaattagccaccaacatgatttccttggcctcccacagtcagaataataaaaagaaattccttccatgatctctttattttaacacaccggttgttatttagtgtatcatcaggaggctgtaggcaaatcgctggctggctgtcacagtcaacatcaacccctttgaagtcaatgacactaaatggaaacactagaagtgccattaatgagcatgttttaataatgctactgaagtcttttacatttcaagaaaagtaccagaaataactctgtagagtttatggtagcacgattgaagtgttgctaatcattatatatcggtttattaatcattataaatgccatcacagttaaatgttatttggattgttcatatgcttaacattgaaggtgtaattaagaaatggcctgattgataccaggcgagtcggtctcagttgaactaggatttcattgaatgtagtcctcagggtggatggtattgaatggatccacagcactggggttctatggaggttcttgcatcaacatcccaaaagttcgggtccttctctcctcctccacaccctccattacacaagtgccccagagtcagcgtagtatctatccaacagacacccatgagtggggctgcatatataacaaataaagatactggatgtggacctgaatttgaatttcagagaaacatcgagtatttttgttagattaaatacaaatttaagataaacagaagatatataatttgttagtaaagctacagttcagacttagactaatgtaattattcattgtttatctgaagtttaaatttaactaagcgccctgtattttatctggcaactctacccaggggaaacatgtgtggagccttttatggtctagagatctgcctctaggtgggaccatgatggccatctgagcatatgtacctgtccttctcccacccccaggccctggaaattaaaaaaaaaaaatagatgtgtttaacgagaaatttcacaaaactgacagaagacaaggagaaggtgtcatgtgggtcagaaaccttgagaaattcctgaaagacagaaagaaacctggctcatcttaacagaggaaattgcagcctcagaaatgaactaaaaaggttgctggaaaatgttgtagtatgtctagggatgccccgagctcagagacaacaaatgcaatgagcaaacgaaacagaagctatagagattaattgggggagcatgttcagaagtgctgaacaaagagtgcctgctgctccaccctgtgtcaagcagcaggagcatagtctgtctagatagagccaccagggtgaccgcttgggctatagaggcagagaggtgccccgaatgactgttgataattgggtgcaccagaaaatgagaacctgctatacaccaacatcctcaatgatctccaattatatggaaagcaaaatggaatccacagataggagatcacagactctcaagatgaccaaaattattagaaaaaccaacatcaaaataaagaggcattgaagagcagacacatgcagaaacagggttaaagtagcaactattaggctttaaaagtagtgtaattaatatctttaaatatttaagatatcatctaatataaatgaaaaagaacaggctgcaatggggaaagcatattttagaaataaaaaataggattatttgtaatttcaaaaatataaaactccttggggaccaacccaaatgtccatcaatgcagactagataaagaaaatgtggtacatctacaccatggaatactatgcagccataaaaaggaatgagatcatgtcgtcttcagggacatggatgaaattgaaagccatcatcctcaacaaacaaacacaggaacagaaaacgcaacaccacatgttcttactcataagtgggaggtgaacaatgagaacacatggacacagggagggggaacaacacacacaggcacctgttgagtggggtggattgtgagggggagggagagtgtcaggagaaatagctaatgcatgtggagcttaaaacctagatgatgggttgataggtgcagcaaactgccatggcacatgtatacctatgtaacgaacctgcacgttctgcacatgcatcctggaacctaaagtaaaatcaaaaataaataaacaaataaatagataaatacaactccctgggttaaattgcaaagttaacacagctaaacatcaaatcaattaactggaagatggcattgagacaaggagacagtcaagagagatgtgtaagctccagaacccactgaatgaaagttctagaggggaagaacaaagatcatcgatgggaggaaatactcacataaaaaaaaagaagaaacagaaatagaaatgcatggaaaaaaatggactcctcagactataataagacagaatgcaagaagaaaccttacatataaagtgatgaaattctgtaacagatgatgagaaaatctgaaaagctgtctaaaaagggggccagaggtagaaaactttacctatgataatctgcttctcctcacagttctgaatggccacactgaatgctaaaagacaatagagtcatcttttcaaattttcaaaagaaaaattgttgtgattttgaaattagcaccctctactccacaaacttgtgttcagctgggagatttctagatatgcaaaaattcatagtttgccaaccatagattgtctctgaaaaaaaaaaactagtagaaaatgcatacaaacaaaacaaaacactatcacaagttatgggaagaaaagtaacatacactataaagtaagaaagatacactggtaagtacaagaaccaataaaactttcatttaagcctaagtaactgttaattggaaatcaaaaaattaataacaatctggaactaaaacccctggaaaataagaagttcacattaattatggtcttacgtggcagcaggcattattctaaactctttttgtgtgttagctcacttaatcttcacaataaccctaaaaagcatttactactattatcattttatagatttggaaactgaaggccagggagttaaaaccttggccaaaggtcacagaggtaggaagggatgggtttgagcaggacaccaaccatgggaatcggctccagagactccaggcaacccataagctcaggcgtcaaggctgaagggtggaggtttgggggaaagatggaaagcagtgaaatggggagaggaaggttcttgtttgattgttggttagaattccataataattccatatgtggaggaagaggatatagttcactctactttaaagagttaagtgaaagtgttaagtgtgatctctaacacagaaatagaacatacaatttccaaaatgataggacacccctccactcactccagtctttttttatattgcttagtagaattttatgtcttgtccatatggttgccacatattcttttaatttttaggtattctgtatttttcctgtcattgtgaatggatcacattatgttgttatatatgaatgagcaattgttagtaaatagaaaattaactttcgcacatttattgtgtaactcatacccctactgaactcttatttttctaatacttataattggtcatcttgtgtttggggggccaaaaatgtggactaattttatattttccacttcaacatgcaaaatttttctatccttttttatccagctgtattgcatagaacttccctaaagcattaaatcatacggggatagctgacctcatcatttcaccacctttaaggggaagaagctggttaccccatagggtagtttatgttctgtgtctataggtactgaaggagctgttgaacattctactaaacgcttgcctgtgaggctattcagtccccactttggcttctcgagtttcaggctgaattactggctctttcctccttccttggacatgtaaaattggtctagattggcatgtccacctacacatgaacccagatgaagtctcagaggaaccacactcctagatctcaccactggacattttacatcttgcgtgatgtttaagagacacttataagatgactccagatgcaaaatatgctgcctttcacatgtaagcttcttgtgaaagaactctggacattaattttgaactatcatattctaccatcattctgtcctattatcagcctgaaagcatgttattcattatggccctcaggtcaggaaaatcaatgactaatctcaactctgtatctattgaacattgatagctgcatgggtcatatgtctgacataagactttgtcctcaagttaatcaattcctacactgatgcggcctatgctctctcacgcagcccttgtgtgttcccagatgacacgtatttatttacaacatttacttgttatattctagaataaaattttcccatttggagtcttttctgaaaacaaaagggcattaggtctaggacaaatccaccataaggttcaaagattttggaaagaagaatgttagaaatctatgtatgaagttctttctgaatcgagcatattttaatatggactattttcctgtgttcttttgcattttaagtcaacaccatcttcttctcaaaagcatcttttgacatgttcaatggttggttggtttgattggtttcatttctggctatttactttgtggttacctccagagagaaatcacttaacattttcatgagtatcaggcctctgaataacgtgaaatcttgggcagggctcatgtaccattttctcaagggctttcccaatactcagtcaggcaggttgacacatacaaccattacatccaaaaagcatccttcagcagctttggcccaaataaaagaaacagaattgagctaacaatgagttcctttacttctaatgaaaattgctcaacaaagaaccaaatgttagcatatatatatatatatacctgctctcagaatgcttactaaatggcaggtgcggtgttaggcttggggtataagggtttccttccatctaattaaaattatgcaaaagggaacaaaatgtcagcctttccataaaacgcatacctttggaatctctcttaggaaacaggccctgtgtctggctagaaatgtaaggtgggaaggagggccagggcacccacagggatggcggtaaatgtattttgccacaagtaaatggattgtgccagatgttgtgggttacacggccaatatgtctgatctataatattcactttaagtataagaaattttgagaaaaccactcttcaaatagcatgatcaaaatgattcaaatagaatatttttaagtgaagtaggtatttaacacttaagaaacaaaagtgtttttgaaaaagggcttggaggctacgagtggctctaaatgggaatagctgatataaattgtcagtggatagattatttctaacatcatccattccaataacagtgcaaatttctatctagtaagttactcaagtgagtatctgctttaagtacactgacttcaagtaccactcaaaatttctaatctttggctatgtgatgtcaaactttctttgctactaaatgatctcacatgcctctagctccatgctgctgttgatgttttcttcttgctatgtgattttgcagaagacatggaagttggcaggctagctgaaatgaatactccagaaactcataattagagaagaaaatgattcttatctactccccaaacatactgaattccttggtgaggctatgcaggtaagataataaaaaatacataaaatgtctgagcaaatttcatcaaaataaaagcatttaacaaataagattgtcaactttcttctgctcatttgactaaaaatttaaaaaaatagcaatggatacaatttgagaatactaaaacaggcccaatatgaattcactaaaggcctaacacagcagaggagaaaaccaaaggcaaacataatatatcttatttaaactgacacaagctttgttttgacacaacctatggttacattgtagtttttggagactgtaaatcagatgtttaggactgagaaagaagaaaatagaagatcattttcttctttcataggatccattatttttctccgtatttgaaaaaaaaattttaataattattacactaaaattatgctttggctatcaatattttatttcatgagatatcaaaatcatccactaaagcagatgtataataaataaataaatgtattcctctttcagggcaatatccagttgctgtactcaagcaggctggtgtgaagggtcacgtgcagctcttaaaataaatggtctgcaaagctccaacactaatgcctaatcccatatcttgtcctgagtatgtggccctcttcccggggatgccccctgtgactccttggggcaaacctacttagagaggtctaaggaagcctgcccaggggaagagtgtcctggacaatgacctcacacttaggcaagacttaaatctggcttcttttattcaaattatctcagagctggtaagtggcaattggccaatgctcaggctgtccccactgtcacatgtggcctgcctttccactgtgtcttcttctagatatacaaagcagttacagcaggtactgcacctattgctttttgtcagcctcatggagtggctcttatgccacagagttgtccaaacccatgggcaaaaacagataaaatggaagccaggagtctccacccacagagacagggacaagttattctcctcagatgtctatagaatgtggccagcacattgttcgcgatgtcctcaagttcagttttggacagaaacggtcatacttatatgacacacacccatttgcctcagtttcccccactaggagacagtaaaaagattggtggttgccaggggctgaggggagggagggatgaacaggagagcacaggggattttcggggcacgagactggtctgcatgatgttctattggtggatgcatgtcattacacatttgtccaaatccatagaatatacaataccaagagtgaaccctaatgtaaactatgaactctgggtgataatgatgtgccaatgtaggttgatcgattgccccacccccaccagccacacaacccacatcagcactttgaagttattctatatttatatacttagattgcatacacaacctgaagacttgaatggatgcaaatgcaggcaaaacaataaggaggtaacagtttataacaggcaataaatattggcaaatttcctgattaaagtcaggtttagatttctatcatcaacttcagtgttgtctttcatcagatcacctttaaattaccactgccaaaataatattaaagtaaaaagaaaaacaacacaaaaataacaattctttaataataattaagaaaagatgttgtattaccactaacattttacccattcaaaaggggcatgatgccctaatgccttgaaggtaaacctggtagtcctacaatcatgagtggatattcttattcaatatatgcattgtaagaaggaaccacagataaaatcaactgacttgccagcagtggtcctcaacttacagacaaacacaacttgccactattctctctcttccttggcaaatctatgaccaatcttcctggattacagatagaagacacacaacagcttttataaagtctatcagttcatttggaaagttcattccttcacccaaaagctatttattaaatgcctgctgtgtatgacacattcttcttggaactgcggacccatcaacaaacaaatcagataagcaatggagctcgtatttggatgaggtaggaaagacaaccaacagcattcaaaagtaaatgttatgagttggaaagtggtaggttccataaaatactataatcacttgttgatgacttcttctgtgccagaaaaacacaaattaccaataaagtgttattgcacctttttccagaaaagaaaactaacgttcagaaagattaagaaccttgctgaaattcacacaaatgggaaagctaatgcagggattccatgtcacatcagagggagtttttctagtcatttcacaattagacccttaagcaatccaaaaatagaccccattagttatctgaatggaggaaaccaggctctatgcatgctgcactctgagcaagaagttaacacattgatcctggacaccagacaacccaacatccatttacctccctgagacccaagctcctcattatcatctccctaatgtttgcaacatgcaattctatttactttccatttttacataaatctttatttagaagaaaatagcataccatggaatattagcctgtgctaaaaagaaatgagctagcaagcaatgaaaagaaatagaggaacctttaatgcatattactacgtgaaagaagccaatctaaaaaggctacatactatgtgattccaaatatatgacattctagaaagggtcagaccatggagacagtaaaaagattggtggttgccaggggctgaggggagggagggatgaacaggagagcacaggggatttttagggcatgagactggtctgcatgacgttctgttggtggatgcatgtcattacacatttgtccaaatctgtagaatatacaacaccaagagtgaaccctaatgtaaactatgaactctgggtgatgatgatgtgccaatgtaggttgatcgattgcaacaaatagaccactctagtggggaatgtcaacaatggaggaggctgtgaatgtaagagggaggtgggataggagaacactctatacttgttgcccaattttgctgttaacctaaaactgctctaaaaataaagcctaacagttcataaatatataaatatatataatataggcctattagttcataaatatataaatatatatacctgtaaatatgtatgtagcagcatctatctatctatctatatatataaaacattatatatatataagcatactgtcatctcatattaatgtttattcaaaaggttgtacaatcctacacttatacatttttttgaaaatggcctctatctttcccacacttgcctagtttgatcactgtgagactcctcaagaatgatgcccggtaaaattaattattaattattaacttatttatttctatggggagaacatcagtacagtatttctgtttataaaacagaattgaaagccatggggcaatggaactaagaagagaaaaatctaattagggcctgacagcctttgataataggattaaagttattttcctcccaactactaatatgtgaagtcaatagtgttgtgttttctcttcttagaaatgtgtggtatgcccctgcaagcaacttttcccatgctataatgtttgtaactcacagaaaataaatatgatttctttgatgcactatcaggaagatgtcagcaaaacatgaagtgacacacaccagcagcctctcagaaccgagctttacagaaatggaaacttttgaaagaatattttctagcagcaagtaacaaagtatctgtttgaatttgtttcttaatatgctcaggttcaatgcaaagaatgtaaggttaccataactttaacaagcagcatctatttccagcatgtgctaaatattgtacctatttttggtaaattttaaaaaatatattttatataaattcttatctggacctgtacttcaaaatgttcttcataaaggctgagcataaaaattcctgtttaatcaaaccaaattaaatcagcaactatccacagagctcttctcccttgtgcaattggtattgtgggcataataataaataaaatttaagatgtaatttaagatcttggcctcaaggtgcctatctctgggggctataggagagacaaacaggacacatcaaagttaattatcttttagctctcaaactcaagacaatcatagaaatagaacatcaaggcagtacaatatccattcaaaaattgagtaggtatatggtgatggacatagatctccttttccttctgaatataatctctttgctttccagatgaatttccacaaatgagaccttaatcagaacagagtctattcaggacacatattgataattatcgaggtcagtggctccccaacgcggctgctcatcaggagggcagatgcttcctaattgacactgctcctagcccccaggccctgatcttctcacttagtaggtcatggatgagtcagcttctgccaaatcccccccttcaatgcccccctgaaccaaactaacatttgtacagcactttagaatttccacaatgtcccttatcctcctaattttttaattctgtgcaaaatcattgttgccatcttttagatgaaaaaacacagattgtataacgtgttcctgttttcagtcagtgaataataaataccatgggttaaatttagatattaggcaagagatgtttccaaaacaagtattttgtgctttagactagcatatatcagtggcatcaaatcacgtacaaaaaattatgctttccaaagtatctggttcaagtgttcaaggttcttcctaagaaataacaaatgcaacctttgacatatttcttttaaaaatttttaactgtccatatatattaaaatatttattctgaaattacaactagaaatttcagtaaaagaatatttgtacctatgtgcacaaaccaacttcaaaaccaaagtaattgtaggatattccaaagtgtttaaattctatttttctttcccctttgaggctgccattattttaggtaaaacaaaaatctgtgttccttctaagccataggacttcgatatcttcagggatacctggcgtccctgtgagtaattacccaggcagtgattaaaccaccaatactaggagtcagcaggcaggctgtgtccacaataggagtttctgaataacaacgtcacacaagagcaaattcaagagctaccgtgaagcccactcaagggaaagcaagcaagtaaatgagttgaaactggaggggagaagctgattgttacaggagttctcttgcccttagcttttacccacccaagcaagacagcttggttctctgtttgcacaaggaccatgtttagaaatagaatctgtgctccatcattaaatatatatttattgaatccctactagtgccaggccctgtagcaagccctcgaatatgaaggaacaagactgagccccactgtaagggagtttacatcattgaataaccagcccctcaacaagactatagtgagacaagcgtacactcagcaggatgcgtccacaggaggatgaagagaaaactggcggggcctccggctcccactagttcttgacagagcaaacccattttctttacatttgaaagtagacagtaatgggtaaataataaatcagactatttgtagtttatccttaattcttccagtttagcaatttgtccctcttatttacttaaactcttaattcagcctgcttaatttttcttcatagtatttgtttttacctgatcgactgaatactcattggtttactcattacccctctgctcccctctcccatccacacacactagaatggaaacttcatgaggacccagatttttgtcactgttgtatccccagcatgctgggtacatagtgggaactcaatatttcttttatttcattattattactattattttgagaggaatctcactgtctgtcacccaggatggagtgcagtggcatgatctcggctcactgtaacctctgcctcctgggttcaagcagttctcctgcctcagcctctcaagtgtctggaattacaagcgtgtgccaccgcacccggctaacttttgtgtttttagtagagatggggtttcaccatgttggccagactggtctcaaactcctgacctcagatgatctgtccacctcggcctcccaaagtgctgggattataggcaagagccaccatgcccagcctcaatatttcttaagtgaacattggaataatgtcaactaatgaagaatgtataattgtataatctgttaaaatgcatttcagatgaagcttaagtgtaatatactaatagaagtttattttataaggaagcactagaaacttccacctagacagtccacagaggccactgaactgtaatgaagcagctatcactaacattagaattacagtgaatatagccaaaagaaatattaccatgtttttttcagatcagaaaatatgtctaattcaacccagctgggatgtggcagggtcaaaatttgaaattcagagttgttggaacttaaggtataaactctgtctgctcggtcaccagcctgcctgccaagtagtcaagaaaaaaatgaccatcctggagtattcaattacctgaggaaggctgggtctccaaagggactgcctcgatttttcacttctacagaatttttagatatacatttccacaatttacagataagtctatgaggatctttttaaagcccataaaaccacacacacaacctgctaccagctaccaggagtgacaaagctccgagtggagcatttgagataatcaccattcatttgtgttttaatatgcatagagagaacaggccttgaaatagccttgcatatgaattcaatatttgtcttttaaactagttaatctggtacagtcttacaaatgcaatgccttattaaagagagtatcacatggtagcatttttctctcccctttagttgagcacattagatacttatagggacatggtatttctctcagaaacacttgggagctagtgaagccacaaagctaaggagataatcagctgatgatcaatgatgagctcccaagagtaaccagcctctatatagtcagcatcactggtttctcaggaaaagcatcaccattgttcatcttgctgcaaaatgtatgcacaagtatctttttatttttaaaaaagccctgacattttatgactgctgcttttctaagatattttcaaatatacagtccatacggttcagacacaatggactggggatagagacggctatagtgccgataatggagaaactagccagagcttcagatatttgttttccaggacatctcaataattgggtacacctcacaatatgtgagacttgacgtcgagtggcacggcatactctggcgcaggcacttgataaagactgtgtttgcaaatacttagcctgcacttcaagataccaggcatctaagcacgtcccagatggtgacagttaatcttcaaaaaaccctatgtggaagtattatcattgtcctcattttacagatgaggaaaaagagacacagggatgtcaatatcttcctcaaggtcacacagcaagtaagtgatggaacagtggctcagccatgaagctattgctgttaaccactaggttgatttgccttcattaatttcttcctaaaactgcacatttcccgttagtccctcttttggtctgtcgtttgactcttggctactgcttagaggaagattcattctattattttctaacttagtaaattatgtgcaactccttggggacatgacacaggcaaagctgtatacagagatgtatgccaagacaccatcccaagttaaccctaacagtctatctgatcctgtatgtaagtgggtatattgtaaatatttttaaattttctgtatactacgatgttttgatagtttaaaaaagccttctggctgggaagagactgcccctccctgggctagtcagttcttaaagatggccatgggcccaacctggagcttacctttgatatgaaaactaactgatgcagagccacacctcctctgtttgggccatatggccccaggaggcactactcctctgtcataaccatcctggggccaggcaccacatttatgataatatatttggaagtatatcattatcataatctgaggtgtctaaatacagcaatgtcaccacgaggggaaaaggactttcattcaccatccatcgaattctttggagataattacaaactttgtaatactttatttcggttcagaaatacaatttagaaattttaatacaaatttctggaagttctgacatttttaaaagataaatttaagcttgttatccttcagcttgctcagactactgtatggatgctacgtggaaggtggttgatcattgagggaccatcattatgaagatgcggggtccacagcgtacatttcccagccgagatatagcagcagggaataaaacagtgggaacagtagatcagcctcatattgcaaatcggcggcacacaccctggagtcgtttgtttcccatgagcacgttgtctaagtactacgataaccaactatgacccagtaaccttgtcatgcctggggccattatgactcaagactgcatacctggaatcaaacttaaactgtgaatatatatggcatgtttagcatgatttgggctgggttaggtgtggaattgttagcctgtgttttcgtctgtatttatttgacatgttctgtgtatatgattaacaattacagaattcactctatcaaacagatatattagttatggcaagctataaggaacgtaatgaaaatgtatgaatgctgcaattatgacaatgccgcaactatgtgtgtaaacgcaaagcagtggatgtaaacataggcagcgaaaggtcctcctcctaccttccatgagaaggaggcttgtgcttttgtggtgccacctggtggaacaagggagatgagagaagagagtcctgaaatggttaactggcccctagagacactcttcacaataatccaagtcctatgctcttaaaacttcacaaacctttatggagcacttgaaaaacaattttttaaggaaaaacatcaaagaatttagtgtcgtgtccttattttctttccacctcacctgactcaatttccccacatgaaaaaatgtcatcaaatgccaaataaagaaaaaagcagagaatggataagaacaaggggtgtatttgctaatgaatgcactccaaaaccacagaaattaacaaggttacaaagcagcctagcttccaatggaacacaaaggatgcctcattgacctagttatttgcatgtttgtcttcttcctccattaaactgcaagctatctgaagtcaaagtaacattatcagtcaataccttacatagagagtacactctataaataaactaatgtatgaacaggaagtttgacaggcagcatctttactcatggtccagaaatggacagttcagttctttagtattttacttctcttttatcgctcaagacaaaggatactacagcaatagcagataaataacaaaaccacaaccccatctatacacagatattgctgttaccttcaaagtgtcccagtctggttgtgtatcattaactttcatccactaataacaaaaaccaaacatcacatggagcacagagcacagaagtgcttccatcatagagtaatatagcaagaagaaaccgaaataagaaggcttggggaaaaaagtctgaagctggttctgccctgaaaaaaaaaaggttttattttacagcaataggttcataaataaatagaaaacaataagaaaatatatgagatctgaagctccattagccagtatccatctgttactcatattttaatatcttctatatcaccctacagcgcaacatatgcaattaagaagaaatggctatgcaactttttggagataagttattgtcaatgggccaaccacacagagccagatgtaaattactaagtcaatttagcaccagtttataaagttttgattaatcctcagctcattttatgttattataatgcattattaaatgcagcgcatggcttgaacttgctccttcataaattcactacatattgatcctgatggtggggcggatgtcatccccatggggcctctgaagtgatattctttccaaatgacaagagagcttctgctcataagacacatgttaagaaatatctggcaaaacagcaaaccttccaacggttttcatcatgttagcttttgacatgtgcatttgtaatgaaagtgcgtcttgtagtaccagcaagacactcattttctcctaactgatccagacatcatcccactccatcctcagggaacccactgagctgatccatgctgatgtcacacaatggcccacactgaggtttgctgaggatagggcactggataaaatacaggacacccagttcaatttgcatttaagataaattatgaataacatcttaatataactatatcacatgcagtatatagggtatacttatactgaaaaatttgctaattctggcaaccccacatgcagagtttcaggttgtggtctgtgcctggctgcggtccacattatatgtgttttaggagaggaatatgtttatgctacaattccaagcacacttgctccctcctgaggctttccctgccttcctggagcttgccaacacacctcttctaatctggcgttgactgtatgagaatctttcatcaatatcttcagaagttaaactgttaattaaatatcaagctaagttaatatcctagtggaagaattaaccatccctgcctttatgaaaaaaatctagatactaatataatggtccctgtgtgaggctagaatttcttacactgattttcttgatatttatgatgatttaatacaaagactatgggaagaatcaacaatattctgaataaaatggcttttatccaattaaaatatacttggataacaaaacaccacagcagtttcatgcaattgtgtcaaaatggttgctaacacaatttaatctctgacctctatttgaaatttcctataacacagaaaactaaagtctatgcttacttgcattcttaaaatgtagaaggctgagataagagaaactaaattgccaatgaattacctttactctaaagataagtgtcaacatatacatatgtgtctacgtgtgtgtgtatttgtgtgtgtgcatgaaatactgtattaagtatacatataaaaacatacacacacatccttctgagttttttcctatgtagagaatacagaaagagcattaagtgggcaaaggaaagcatccaaaagcaatgtcagcaatggaggagttcagaaacatgaagtagatgctgatgttagccatatcccttcccctactcaagagaaggaacgaccagctcccttccctcctcctgctggaatccgggctctgggctgcaggggcagcagctgtttacaccctttaagtactgacatgaagacaaaaactactcgccaaagatgactgagcaaaagagaaaaaagcctgggttccaatcgtcaccccaagagcacccaaggactcaggacacatagctgttacatgacaaaaacacaggtcttggttggctaatgtgccaccaattgggttttcccataggtgcagctactcattttcctgttacaaaatggaaaacccaaaactttccattcatccacccgtagaaaacataacttgctcagtttctagattgttctactgtaattactaagcataagatggaattgaggtatctatatttttttgtggcctagagactatattcaaactgatgaaggctaccacagaaacctaaatggacaaatatttaatcatgagcattctgaattggctcttactctttgtccctaaatatttttttaaataaaaaacaacaatattgaggaagtcactgaaagatccaggttaagaactgaggaaacacaacacattcctgtgttcagcatggttatttctccttgagggtagggtttatttctctgtagcagttaagacagaggatgggtgtaacacgcatagttggaatttaaataaaagcagaagcagccaactatttgcaacatgatgaagttccctatatatttaaggaattatccacagatatatatgaatatcagaggcaccatttggcccagggtgagaatgccaggctgagccaaccatactttaagcacatgtgatttgaagtagctgagacattcatgacaagactgacagtatcccagcaaaaacttaggccagagatagcagagagctggcctggagtcgctttcagctgtgggtatctctaaacatcctgtgtcttgagcttacagagttgcatgggcttcctcaagtgtcagccagcctagtcctgcccaaggaaacatgtgctgagcttgtcacttggtacttggcaggctcgcagagaaaccagagagcgcagtcatagtgggaggcctttagcactgcagtcctcaacttcaaggagaggagcaagcctttgaaatccaccagagacaagatgcctgagaaaacaggggccactctacaactaaataccctttcccaaagggttctaattgggggaaggacagagtgacggagaaggaagaaggaaaggaaagcaaagacaagaagaaaagtgtcaggggtcaacagattttgttccattctttgatttcctggatattttcccaaagggatggtagcacattaaacctggactcaaccagagctacaagttttatttcagtgaaggcattttcttgatcattttgcactgtgtccaaataatgatagcacagggaatacatgaataactgggataaagctgtcagtgaaaggaaacagagcctctggcttctccagtattgaaaatagcataaaagagagagagagagagagacagaatgaatgaattcaaaatacattgtgaaaccactcatccatttgcaggactaggtacgcataagaggggcacttcttcaccccccaggaggaagagacttgtctgactttcttccttaggaacacagaccatgacctaaggcagaactgtgaggttcagcagggaagaggaagctaaaagagccccgagggctccaggcacaggtaacatcttggatgctcatagcaggttgctggggaaagcctgtctgtatctaggaggtggtgtcctagagactatctatttccatgaaaagctcccagtgagttaatttcagagccaaacacaagagcctgggctcacaacatccatgttcactccattaccatgtgctactgagcagattcatccacacgctggagccaaccttgaatggtttcaacttcacatggaatcatctctgtgtattttatgtagcatcctaaagttgcatttaaaattttaaaaataaacacttcaaatgttggacaccttctcatggatgaagatctgcataacagcactgctcttacaatgccatctctctttaaggatagaggagttcattgcccgccacactgggaatattataaaacaacttcttaggatgaaacaaaaattaattttaagtcatagatttatttaaaacccaaagatttggcatcatttaagtcaataaatgtccagagtaatgcctggaacagacaaagtgctaaataaatggcatctggcattcaccattccctctaattataacgaaatacatttcacggctgggcgcggtggctcatgcctgtaatcccagcactttgggaggccgaggcgggcagatcacaaggtcagggatttgagactagcctggccaacatggtgaaaccctgtctctaataaaaatacaaaaattagccaggcatggtggctcatgcctgtaatcccagctactgggaaggctgaggcaggagaatcgcttaaacccaggaggcggaggctgcagtgagccaaggtcacgccactccactccagcctgggacagagcaagactccgtctcaaaaaaaaaaagaaaaaaaaaaaaaaacaaaagaaaagaaaagaaatacatttcactagcatcatattatacattgcaatcttcttgctaatattataaaaccaagaaaaaaagtttatttttacaaatacagtttccacaaaactcaaaaaacctcttttcattaatgtatttaggaaatattcagcttctgttgttttccagaaacttctgcaagctctagagatgcagaagtaagcagggcaaagtcccctttcttgcagaacgtggattcacatcaggagacaggtaataaaccaataagtaccggggtctcaaatgcaacagcaggtaagcacaagtgctgtgaagggcagagcatggtgaggcgcaaggggaatgcttcgtaggacttacacagagtggtcagtagagctgcccctgaagaggaggcatcagcacagaacccttcctaaagaaaagtgagtacatgaggctgaaggacaggtgcaagggaggaatcagtgaatgagggcaaagaaggagctgggagccaaatcatgggagctgggtcaccacaggtcccgagcagagataccacattgacagcaacactgccagcggattataccctgatgtccaatcaatggcaagggccaaagcatcgggttccttttatgttatatcctcatttttcaatctatcaccttctccaaaggcttccattttcctctctgttttcctcacccctgtgcttggtgtaatagatagtatccgatcatcatagcagccttgtaactcatttttaactgaaataaatacttgttacttagtacataatttctcctgatcaaaaattccaacaaagttcagaacactgaagaattgaaattctaatttagttttactatttatcctgcatttgagcagaaaagacaaattctaaaacaaaaaaaaaaaatctagaaatatttagtattcctacaatgataagctgatttcatatcaaggggaccaaggatgtgagtcccagttccctttccctgccctgaatctagcacttatttctagaaggcaaaaggcaaaagcatttcgctttcagtagagagctcatttgggcttggtttttcctgaggaaatccatttagtataattttttaaaaattaaacttcacatgcctatgactcaaactttcaaaccacccccacactccatcagttattttcaataattaacagtgggtgatctcagatacagcctggatgttttggaaaacaggaaatagtctgctagattgtagcctcatattccccttggaaggcttcttgattgaatgctacaagttgtcaaaccagactggttcatttgactcccctgaagcgcttgcaggagagttacttagtctctctcttccagaaaggagagcagccagaatgccagaacccaaacatagtcaccccaggactctggtgaaggagaaccttgcaggtggctcccaaaacacctctgctggcagcttttcccaagaggaaggccaaatggccgaagctaagtcaatgatttatttctaactgctgctaggaggtatcgtgcagggttatggataagtaccatgacttttctttgttgtctttgactttctggcttacaatttctgtgatcaataggaatagtctcaaagtgagcaatcagaaatttgtcctggtagattaactgtcatgcaagctgcaaaacagagccagatgaaaaatgcagaaactaaaaccataaagaatgagttgagatatcaagagaaatggcactggactactggtggtcctcaacctcatgtgaaactttcaagtataattaaagtaacacatccaccagaataatttacattattgataaaagaatagaaaggattagataatttaggcttctttttagaatcattagaagactgagcaatagacaaaggccaatttagttgcaaaagttttaattttattttagctataatggggacactcttttagcaggctatgtaaattgctttaaattcaagccattggtgaggagttgctaaagttgcccgatttcttagtttgtttatatctgcatttagctgctatgcaatgtattaatacatgaagatctaataagatattaaacagctctaatgttcagggtgactcccaaattatttttgaaaaattaatataatgggtcatattagaaacctttcattttgggctgcaagtaactatccagacagtcttacaaggttcagtgcttagagagactgccgacaagagatcccatttaaagcggaggccatgcttaatgaacaacgaaatatggccccatggggtagggttgaaagggaaggtcctaggtctcttgtatgctcaaaataaggtctaagatggcttatggggtccaaaatctcagtatggcttcaatgcatcccttacaaattgtgggcaaaaattgcaaatggacatgttaagaaggtgatgaaatttatcaaaacaaattatttgaaagccaaggccaatagggagcttccagagcagcacctccagtcatcaggtcacagaacacaatcaacaccaattcccatgggttcactttcatgctgaaatcatgcctccccctctatgtgctatccgaggatcactgtgtttcctacagggagctctttcctgtaacctcccagactcatgagcttgtgctgagataacttttaaaattgaatacttactgagtatttattgaaagctggtttcttttaagtttgctacaaccaatacaaaaatcaaatgggcatcaattccttgtagagcaatgtttactcttgttagaaaggaggtgccattagtaagataacataggtattattttactagaaataaaataattgtaataaatgacatgggtgtgtttcattgcaattaggtttaatcatgttttctcactgtaataaagaagcacctgagtcgacatggaaggcgtgattgagttttcaccattgccctaaaatagtgggtgtgtatctccattatcttcaagtcactttcaggttaaaaccatcccagagtatttggtgcagatttacatgttaactagttcctcagagagaggggatgtgagcagtcttaaagaatatgccatctggtgcagtacgacttcccggtaacagtttatctaaatgtcatcattttgtttttcccacacatgccttaatcaccttcttcaggaataaattgactctcttgtcatatatgcttttccatggtttctacacagtacagctctaaatgcttattgccctttacaggttgtactcctgaggtctttccttatttcttggcttccatatttgacgcaatctcctgtaaagtctttgagataaagtctcagtcagtgtaagagagaaggaaacaggcacctgcaagtgctgaatggtgacccaggcagaactcgtgctctaccctagaggcacccaccgtggaaggctgcttttctagcatgaggtaaaacttcagggacgggtgcggtgtctctcgcctgtaatcccagcactttgggaggccgaggcgggcggatcacgaggtcaggagatcgagaccatcctggctaacatggtgaaaccccgtctcttctaaaaatacaaaaaattagccgggcatggtggcgggcgcctgtagtcccagctactcgggaggctgaggcaggagaatgacatgaacccaggaggcatagcttgcagtaagccaagattgcgccactgcattccagcctgggcgagagagcaagactctgtctcaaaaaaaaaaaaaagaaaagaaaaaaagaaaaaacttcagaaagctggcttggggaagcatttccagaacgtgatcatagaatcctagcaactagggaaagatgagtcactgtgaggaggttgagtctgaagatacaaagcttcgaatttatcaccctgcattccacaaacaaccacagcatatgctttctccactgtttctcattttggtcactagagcacctgttctatggattgagcaagatgccagggagtgtcatctccctcttcctcatgaagcccccaccaccaccgcatccagtagtcaccgaatcgtgtacatcaagcctcctaaatatcttttaagtggacctatttccctcccactcccctatcaccactgtaaatgtcgccactgtagtggtctccttgcgtctgatcgctccttgctgcaatccattctccacgttgcagaagggatagtttgtaaaattcccatcaatgcataccagtgactgtggaatggacattagccagatccagcattttcagtcctttggctgctgcaaactttcttaaatcacactcctttcaacatgcagctccctctgcctggaatagccttcccctctgtctacctaggccttctcccttctgcgggtgtccagagaatggtcctcctttgtaaggtcttccttgaagtcccctgcttaccaccgtcctgctctgtgctccagatccttctctattttcccttccacagccctcctgccacttcactgtagtcatgttgcaactacccatcttctttggcacgaaggaagttctgacaggtttcacagccatgtctgtcttctccgtcactgtattctcagtacctattatagagtaaatgcttaaaaacataggatgaagaaaaagtggatctacaactagggacaaatttacaatgaggcaaccccaaggatgcttatcagaactctgcagattcaacagtgaaaatggcaggcatgataaatcaatgacttaaaaagagaagggagtttacataatctgcaagcactgagcaattctggccaagcagagggtatgggtgggtacaaggtggtgctttctactactcaccaggacagcatcactacaaggggaaggcaggtgtccacaggggtgaagaaaagagcaggatgagaggaggaatttggaaagttcacttttacatttcttctatggtccgctaagtacccattgcctgacacttagtaggcatccaacataaaattattattattattattattattattattttgagacagagttttgctcttgttgcccaggctggagtgcaatggcatgatctcggctcactgcaacctccacctaccgggttcaagtgattcgcctgtctcagcctcccgagtagctgggattacaggcgcacaccaccacgcccggctaatttttgtatttttagtagagacaggttttcatcatattggtcaggctggtctcgaacccctgacctcaggtgatccacccaccttggcctcccaaagtgctgggattacaggcatgagccaccatgcccggccccaacataaaattatttaatgagtggatataggttctacagcctcagagcccctgcaataccacagtattagactatccatatgtacccaaagtttatcattgtaatactctaaactctgtaagaagcctcagaatttcatcttaaagttgagtttctgagttagaccactggcaaatcagctgctctcactagatagtttttctccaaaccactcattcattaattcaagaaacatgtattgagaacctaccatatgccaccccctcttctaggaaatggggagacattactgaacaagacaaggtgcctccaatcatgaacgctattggagaagagagaaaacaaaaagtatataaactagaaagaatattatttcaagtaataggagggagaaaggaactaaacgcagaggaaaaagcaacagattttacatggggatagaatgtctagggaaggactctctggtgaggcaacctccaaggggccacgacggtggaaaaattaattccagggaatctggaaagaacattaaaagaaatagccttaagattgaaagccatgccattttaactcccgtggcatctggcacaacgcccagcccagaagtctcacctattcactcattcaatcttctgttcatttacgacctcattcattccttctacaaagggtcagtgaggattcacagcacaccaagcactgtgttagacagtaataatacaacaaacgtttattgctttattgggagaattagtgtgtatttgaacacattaaaacctccagtatttgacagattttgacatacaaatggcaacttcatgtaattcatagatgctatttatttctagattggtaagcacaaactattgggaagtaaataacgcattttggaaacttgatttttcaagttctttgtaagaactcttttacatagcattgtaaaagatattttacattgtacttttagttgcaaaggagttttataaacgggttatagcaaactttttaaggaactatataagttcctttaaggaactatttgtcaaccttattccatttacagctaatagttgaaacaaatgaaattgcattttcttaaaacatattatatttctaatccttctcccaagttaatgcaaatttagaaaattttgcatgtattggtatatatcacaattcccttcatttacctcccaattagaatttcagcctaaggctacctttgtaatttctcaatagagaaatgttttaaaatataatttcagataattcaaggaactgagttaaacaagtttggagcatatttttggtgacaactattggacatacgaattgtcaccaactgaaccatggtccattcggcctgccatgcccattccagaagatacccgagaagtcattgttgtcttaggccattcaaattttcgtttgcatctgtggccgtgagtatcacacactgtgtttcctgatatctagtgtaccagaaattttctgaattttccagtagtcattaatggctctttaattcatatactcattcaaaccctatggaattcatttacaatgaatcattataatatattctttaactcttggagtgatgaattttataggtatatttacaacagtgctacatagtccttctacagcttgtcaaatgcacatcacattcaagagattttgtgatgtcataatgtgatgttcctcttatctctgttactcattttgatatggaattggaatatatcctgttcccagttcacactcccttaagttaaagagatacattctttttacaacagagccttatgttttcatctggctaattcagaaggtaattccaacggtgaaaactatctcgagtggtaattatttgggcagtatcatttcatgctactcagaatccaaggaaaagtctctgatatcctggagacagcagtcttgattaaagagcctgagaccacttagctctttcagaagacctctgtaacctgaaatattgtagtgtaatttgtgccccaggtataatctaaaagcaaagttaacattctaccacatggtgactaaacaaacttattgtatattttaaaattaaattaagactaggttttaagtgatctcaccacaaaaaaaagaaagataagtaaataaggtaatacatatgttaattagctggatttaatcattccacaagatgtacatgtatcaaaacagcatgttgaacactataaatatatataacttttgtcaattaaaaataaattaaataataatgaagatgaattcctgttaacaactagaaaacaaacaatttgagggcaagttatgataaataatagtatgtaacactaaggcagacaacattatcctgacaaaatatgatttgtcttcttctttacacagatatcttgttctcttttgaccagagacaaaagaagaaaagtcttggaaacatccttcacagtttggggatgaatgaaggcagagaagtattcatcagtcttatgttcctggcaatgaaagtcaaaggaagtcaaaattgtggcttctagaaaagagaggagctgacatagccccagctccacctcccttgtctcaaagcataagagcataactgattattctcaacctcatccatacataaaaaagcgtgctaaacatttacttttgtatgactttagcaacaatcaaaataacttcataattttgcatttcctttttattatatataacatcatattttactatgtgtttccatatacctaacccttagatcctcctaagccctctgaatgggaagcaaaataggtatcgttacttttcaaatgaagaagccagagctcagtgcatagcagggacttgtctaaagtgatgtgggtaggaagtggtgaatccaaaagctgaagttctggtcttctaactcataatccggtgttattttcctttctatctttttttttctttttttaagatcagatgttcatagtaactgagcagtctctcagtgcacatggagtggttttaaaagtcaacattaatgttcaattctgctgcacggtgttgagtattctggaaagatctcaagaagagcctgatcccatgccagcagaggctctgttatgcatcctgcttttccttttaaggcattttaaattaaaggaagccttagacaccaccatttctttctgtcccactgacaaccaaatcctttcaacgaaagcaccaatttggtttagctacagattatttttatctgttcttgaaagtcacataaacgtgacctgaacaaatacgctcccctgcatgttcttcctgaatttcaaagtttttcagtaattaagcatttttcctagagtgttgcaaaccaaatagagttctgtgccaaagcaaggaacgcattaatgaaaacgaagaataaaaggaagccaaatccaagttgcaaaaaatgctctgccttattttgctgaaatgagatgcaaatatatatatataatatatatatatatatatgcaagctgaggactagagtaaatataatatgttgatgtgaattttcatactaaaatttttcaagaaaataaatatcccatctcaagatatgtttttttaaaaagaatcacacaatcacatgaattaaatgtgtgtcttggtaaatttagggatgttaataattcattccgataatagtattaaaccagaaaactttacagagtgaaaaagtaataatctagcaaagaatcctatcattggatttcacccaaaaaggcatcaaatcctctagattccatcaaatttctttaaaaggaaaaacactttttcttttcaggatgtcttagaagttttcattaaatcaaaaatgtgcacagcttatacagtggttctccagaaaacttcaaccacttggaacacatgtttgtgtttaggggaagacagagggaaaagagaggaaaggttgggaagaaagagatcataatggcttcaacaaaatttacaaccagtgattgtatgatattgtggcggcggcagctcctcacacaaaacagatggtacaatacagagctgtgtcttaaaatgccaagcaactaaagattcactgattccatctacttctgaagcctttcctaacaatctatgccccagagtcgacttcagaatatttttacgttttaattatccccttatttgaattactatagcaattatagcttcatacaggctcattatacatttaaacattaattttatgttttaaaactcaatactcttaggtcaaaagctcactagtgagatagtggagtggaacgttagtttcctatgtaacaaatgaccactgtaacaaattcccataaacttagtgccttaaaacaactcatatttattctcttgcatttctggaggtaagaaatctaaaacgagtttccttgggacaaaatcaagacctcagcgaggccctgctccctctggaggctatagaggagaatctgtttccttccttgccttttccagcttctagagctgcttgcctccctgggctagggcttcccttccatctacaagggaggagcagggcatctccaattctctctctgctccatcttcacatcgccttttcctctctatctgcagcaaatcttcctctgctccctcttataaggactctcacgattacatttaagacccacatggacaatgcagaataatctctcacctcaagacccgtaacttaatcacatctgcatcattccttttgccatgtcaggtaacattcacaacttccagggattaggacagggacgtctttggagtggactatcacaccctccacagcagcagaggttaacctcttaatgtcaatcatttagaactacagtcatccttcagtatacctgagggattggttccaagacccttccccataccaaaatccacagatgctcatgtccctgatatgtaatagtgtagcatttccatataacctatgcatatcctcccatgtactttaaattatctctagattacttacaatccctaatacaatataaatgctaagtaaatagttgttatactgtattgcttaggaaataacaagaaaaagtctgtacatgttcagtacagatagaaccacccttttattcccaaatatatttgatccacaggtggctgaatccatagacttggaacccatggatatggagagtcaactgttacttttaaatcaccttgcaaatgaaaatatgcttgctaaggttccttcaaaaagatcattcttaaaaagagttttggttagtgtagattccactcaaacttaatcctcagctccatgcatcattaaccttatggataaaaaattgtggggtgggatcctgcaattctctcgttctgtcaacagagaatactaaaaagtttaaagccatgttcctcaaaatgtttttctcctacacttaaatcgtattttcataacagcatttaatatactaaactacatcatagcctagcctagcctattctaagcatgctcaaaacattcccatgagcctacagttgcaaaaatcatttggcaactcagtccactgtagagtattggacatttacccttgtgatcaagtggctgacggagctgtgactgatggccactgcccagcatggtaagagagtgtccaccatatatcactaggctgagagaagatcaaaattcaaaatttaaagtacagctcctactgaatgtatatcatgttagcaccatcatgaagtcaaaaactgtaagtccaaccatctgaaggcagggaccatctctagttcgtcatgcaacggaaacttaaaaatgcctttaaaagttaacatagggcagcttaatttgacgttaagaaattttcattgagaaccttgaaataagtgtgaaaaatgcatgtgtaatatggttatggcaataggggagttggcaaagaacttgggagaacgtgcaatgttcccaattaattttagaccccataagaatgacacaaacagaagagcttgcagctgctaacaaatgacagatatgttctgtcacaccccggccagtccaaagggtaatgcagctaacctgatagtccccgggaatagcagctgtcaggaaggtgctgctacatgtcagatccagctccttaagagcaactgataagaaaaagatgaagaagaaaacagcttaatgtcagtgtaaaatctgaaattcacttaatcatgggattttaatttgttaaccttcccaaaaaatagtatgctaagaaccaaactgtgttccctagtcaaggtggagacccataggacatctcacttctccatcaactgccacccacgtagcacctcataaatgaaagtgggacagggacacttttctcttattaaatcattttctcatatctgaatatagttacgacatttgtgaaatcagtgcaaaaacaatctctttttattgaacgaaacatagcccaggtaccatgtgcttaattcaatttaactgaacaaatttactgaacacctacggtatataaagcactgtgcaaggcactgctgagtccaatgtgaaccctgcctttacagaggtgtgcagacatgcacacacacatacacagacacactcacatgacatacatacctctgcacacgtatacaccacacacagacacagatacgcaaacaccacgcaacacataaatacacacgtatacacacacaccacacacacacctgctgtccatgaagagcaggagttttgcccatcacatggagaacagggaacgtacacatggcaaggatttcatagcaccgttggaagcagcacttagaatctctagaaaaagagatttctcttatttaccatttctacactctctcacagtgaactacccgtatagtcagctgtgaaggttataacgcccactggacaaaattttaaaatgtagaaaactgtcttcactttagtatgaacaagagaatcctttgtcatcccaccccagggaaccagtgtgaagagacacgacagtttgtgtggagaaaggggttgaccatttacaaggagagagccatttcctaagacgttgcttcatcaaagcatcctggaaccccagaagagggaagagtatcaaaccgcatctgtgtgcaagaagcctggctcccctccccatgcaactggaagaccaatgagaatcagaaaagcagtgaccacgggccatcctggagccacatgggggcagcgtcttctgggacacaggggaagcactgagaggcatttaggaaccagggatccatggtcattcttacttaaagaacacacccattatttacatcctatcccaatggtggcaaaataataccactgagctgaaaaggatctctacattctaccaaatcctgttattctcacatgggcttcttcaaaagtatagaaggttgtcaatgtgaacacagtgcacttcatgactatcatatcaatccctgagtgtttactttcttctcagtgacattaacactggaacatccatgtcaaggaagtacgatctgttcttttcaaactaaaacatgtccagtccggagtgggtgggagcaagcccaccttgtggccactactgaactaccaaaactccaacagagaaaccaattctgtgaagcctatggggaatgccacattttttctaaagaaccataaattaagtttaaattcatgtggtctgttcactaaatgtctttgcagaaggaaaagggaattggctccaaggattgcagttgctctgaaagtgcatgtggcatcaatactcacttctctaagtggggtcccaggacctgtggcatcagtattatctggaaacagaaatgcagactctcaggttccacctcagaacccctggaccagcttctgcatctccacagaatccccaggtcctctgtgcctttaggttggagaatcagtggaataaacaccaggagtgcaaacaagatcaaagaagttacctgttgtagttcactttttcaaataattgactgaaattaatttttataattaatgaagctagtgatgatttggaatcccttgactaagagaagggttttaatgtaattaatctgcaaaatgatcagtttttgtgcatcactaaacctatgaagtttataaagattattttcctagctggttatgaagaaaataatgtcacaaaagcatctaagggctgtgccttaccaatgagccgaccctctccagtctgctttcctgtaatcatagtgactcaatttctagacttagaaagaaaaaacacagaaaactaacatagaggattgttctcccttctggtcacggtttatggtagcaacaggtgaaaaaggccaacagaagcaacgatttgcctcatcacattaaaagaaacatttgctttctcttccaaaagcgtaagtagtaactatggaaaccagacaaaaacgttgaaaatgacttgcaattcacaaagagcagaacaactctatttcacccaccaaaaaacaaaaaaattaacgatgaaaaaatccaccgaaaccttccccaagaagagctggatctgcagaagacataatgtgagtgctttgctcatgcaccatcataaattgtttgatttgctacagaattgttaaattatgtttttacaaatcggttatttagctgtgactccatttaaatctacaattttatgtgtcctgatgataaaatgggcccttagctgagccagctaattcctcaggtaaaaggcatattcttttggcagtaaattaactttggaaggtcagtaggtggcctatcaccaatgttagagatttaagaaatgcatattttgtctaaaacacttaatttacacctaaggaagctgaatgaatgatctcaaaatttccagctattatctgtttactaagttggtcctctggatatcctatttaaaggttgaaataaatgtacacatgatttatggagagaaaataaagcaggaaaacttcacccaattatgccaacctactcactgcccagaaatttccatccaattccactgccataagcaacttctctgtgtgttctcccatttatctgtttgatgttcctgtatccctcccccactttcagatcagatgttacttccttttcagacgagcttgtgcactgcttgatcttaatggaaccccataaggagaaaatgaccactttattttaaaaaacagaggagatgctgactcaaaacagaagagagtaaagaacttccttaaaaatatgaatctcagtgatacttttatagcccagaatgacatgtttatctttcacctattttttttttcactccaagcaagagcagaaaatttttttttaagcttgataagcaaagactcatttggggatacctgctacctgaattatcactatcagggttaaattaataactatggcatattataaagccataaatataattttgagctccactcttcccagcatatttatgtgagtttttgtctcattttgtgtgtttgtggtgagttttcttcctttctctgtaaaacatggagctgctaaggcatcagtctgttattgtatactgacggagtgtggaaataaatgccaatatcatttgcagagccatcctggttgtgacttttttttaggtgagtatcccactttcaactaaaacctagaaaaagaattctaaaacctttttcccaattaaatgttggcactcataacacattgttgatggattgaccaaattaaaaaacaaaaaatcttaagtttaatactgttttcttcagatggcatcaacagcgaagtatgtccctaaacttttcattgttcaatgctgggttgacaagcaagaaaaatctttttatcaccaaaatgcaaaaacaatctgaactagctgctgtgtccaatccagcttcgttttaatttggtgctaattctctaatttgctcatttattttctctaaccacataattaatgctgaagaaagtcttttacagcttgccactgagccctccatgtcttaatagaaggaaaaattccttagatatgtttcccatcaccatgcatgtgctgaagccaagaactagaaaaccgtaactgtgaagtattacgaaatccacacaattaagtgctgaaaccagcaagggccaaaaccactctgagacccagctcagaccaacccagcctgccctttcaagtctgtaaattggatcgcggtccagtgctttctcttacctcatcagccttcctttttccttttgctgtagtggtatgttttcaatgaactctgacatatttctctgattgaaaaccattttaatactcctagacaatgtgcttctgaaacattgtcacaacacatacaataaccaaaagtttagacctgtgtaaagcaaagtgaaaaatggagtgtcattgaatcccacaattctcgaaatacaagtttatgggaaaagccaaagagagccaagtgatatagtttccagccatggcacctcaggaaggcccctcacctggcctagcagcagccattcccacccccaaattgtaacctcagaggtacagaaccattctccaagtgctgtgacctttcctcctacaaatcattcatcagtccaacatttcctaagcacctactccaggccaggcactgttgtcaggactggacatacagtgaaggaagcaaaggctctgcctcgtgggacccacactccacgggaggaggtaaaccaccaaatacatgagtaaacctatggaggatgatggagaagagaacagaggaatggcgtgctgggaatagggcagggagggagtcgctgaaatggagtgaggggaacgtgagcctcttgaaggacagggcactggggcggagtcagaggggcttagaaggtgagggtgggtagggggaggacaggagctcagagcagggaggtgggagagcaggcactgctcaccagcatctgggcctattgaagatagggattggtctgggattggtctgttattccatattttatactctcccagccaggagatcaaagtcagtggcatcactggtaagtcctgtccatagcactcatccttgatatcatgatgatggcgctttatttctgtttccctccagaaaatcctagctccaggcaagtcatgagaaaaacctcagacacagccaaactgaggacatttgacaaactacctgatcagtcctcctgaaaaccatcaaggtcatccaaaacaaggaaagtctgagaaactgtcacagccaagagaagcctaaggagacaggcagctaactgcaatggagggtcctgcacaggatcctggcacagacaatggacatgagggaaaaagtgaggaagtcagaatagagcgtggccttcagtgagtaatgatgcatcagtgtcgcacattagctgtggccaatgtacacacaagtgcaaggcgttagcaataggggaacctgggcacagagtgcataggaactctccaaactgactttacaacttttctgggcatctaagactattctagaacattttttaggctaggcctggtggctcacacctgtaatcccagcactttgggaggctgaggcaggcagatcatttgaggtcaggagttcgagaccagcctggccaacatggcgaaaccccatctctactaaaatttaaaaaattagccgggcgtggtggcgcacgcctgcaaccccagctgctcgggaggctgaggtaggagaatcacttgaacccaggaggtggaggccgcagtgagcggagatcacgccactgcattccagcctgggcaacagagtgagatactgtcttaaaaaaataaaaataataaaaataaaatgaaatgtctttaaaagtttatcttgttaaaaaaagatgcaaatgctctctatctagaaataatgattccagaataaaaactgcaacaaacaaaaaaggtggatgtgaaacaactgtacaggtgaatgagtcaggatttaacaccgctcggtctattcctgctgagcggtttatgaaatctgctggagccctcacagctggccattccatttatttgaaactctgaatgattatgtttttccctattggtcccagctctttcttccagggccacacactacaaggaaaacctcctttcctgtcagcagtgcctcaagtcctcagagagagctttcctaataaagcacgcgctccctgcagccgtgttctgagcctcccttcaccccacaaatcatgcctggtctgactccaaggaggtgacctagacaccttacagggaggaggggcagagaggacagcacctgctcagttcaggctgcctgtcacacctgtcctcaggatcctccctccctctctttaggggtccagggtgccactgagaggctccacctgatttctgaggtccaagaccgtcctgggttccaaaacagggtctcagacagcctccccgtcgcatagccttcgcctgcatggattgaacttagcagccctttcttcttccctcctctgttacctccacagcctgacaccatggtgacacccacacatgactcaagaaaggatgttgacaacttccatgtagaaaggcaagatcgggctaatgtaataaataatctcataccttggaagcagtcagcctgcacgtacgagacagagaaaatgaggcagagacaaagggcgtaattgcaaataagaggagaagtaggaggggaacggtggctcacacctgtaatcccagcactttgggaggctaagatgggcagatcacctgaggtcaggagtccgagaacagcctggccaacatggtgaaaccctgtctctactaaaaatacaaacatttgctgggcatggtgctgcgtgcctctaatctcagctactcaggaggctgaggcaggagaatcgcttaggaggcagaggttgtggtgagccgagattgcgccattgcactccagcctgggcaacaagagcaaaactccatctcaaaaaaaataaataaataaaaaggaggggtaaagagtatgtctctttactctcctgtatgtgtttaactccacgccctccaaaatgaatgattttaacctggaaagttaaaccaaacatttgaggcccaccataactatggaactaacaatatttaaaggaatttgaaatttaccaaatttggtctccaatgacaagtatgattctgcatctcctgttgacatggaacatttcagttcatgagagaactggtcttcaactgaaattgaatgcacacagccttttatgcactgagatagacgtggcttcccttctcatagctcttcataatgttattaaacagtttctctagggccatttttacttctctaaatgatgacgcacatacatattttgagtttctgtggtctctttttttaacaagataaagcaagtagtaagtaataaaggtggtttcatgtacacagctaataagagtgtttaaaacctaatatcagctgaagaaatcttttccttatttatgtaaaatgggaattaactcatccagtcaagaggaaaatgaaatcaacaaatgaaacgtacacaagagaactgtaataattgccaaactcagctccgcagagaacaatgggattccagcagaacacagcacccgggcaatggcggaatgtgtgcatcgttgcctccttttccagagccttatcctatcacagccctgttagagatgtaagctcctggtctctctttgaagggtgtggtttcagtatctaaagtgattatcttacttaggttcatgaatcccataaaaatgcaggaattgtaaacatttaaagtgaaaatccttcctaggatgtctcatatcttagctataattgcaaccactccatattgtgtaaaattgtttacaaaaattcaaaaagccaaacaattaaacatattctaagtgtctctcaattgccatacaaatctataacgagggacaaagggaaggtgacatgactcagagtctcagcagtgagtcatcaatcatggcaaaataatcaccctcctgggtgaactctctttgtcaacagttggtctggaggaggaggcatacaggcatacaaaaatcagcaagttcttaaaagcatgcaaaaactgaattctctggacaaggtccagtgcaaataagttgggatgatcctcaggagcagaaaacaactctgtcaacaaggtgccacctccaggtcatcctctgtgctccgctcccttacagatggtgtacagggtcaattagtgtctgtcccctaaaagttcacgtccacttagaacctcagtgttatgttatcactatgttatagagcttttgcaaatagagttaaattaagatgaggtctaatatgctttaggttctgtgtccccacccaaatctcatgtcaaatcataatccccacatgttgaaggagaggcctggtgggaggtgattggatcatggggtggtttctaatggtttagcaccatccccctagtgcagtgttgtgatggagttctcacgaaatctggttgttgaaaagtatagttcttctccctttgagttgtctctcctgcctctatgtggaaaagagtgcttgcttctccttcaccttctgccatgactgtaagtttcctgaggcctccccagccatgcggaactatgagtcaactaaacatcttttcttcatgaattacccagtctcaggcagttatttaaagcaatgtgagaacggactaatacaagatcatactggattagagtgagccctaatgcaatgactggggtcttcataaaacggccacatgaaggcagagacacacagggagcactccacgtgactactgacatagacactccacactggaatgatgcttctacaagccaagaaatgccatgaactgccagcaattacaggaagctgaagatagacctggaatatactgtctctcggagccctttgaaccaatctgctaacaacttgatttcagacttctggcctccagaacttcaagagaataacttctcttgctttaagccaccgagtgtgtgctgatttgttatagtagccctaagaagcaaatacagatggtaacaatgaccacaaaaataatgatgaaagtccccttggtcacaatatcagtccttagctaattttcaaccattattaatgcaaaataaatatatacataaacactttttttgggtgacttgacaaatatttaatgaactattagttttcttcccatgaagggatttgagtgagggtcctgcctcacagtcatatactaaccatatatctattgaatgcccaaaatttgacactttggcttagataccatggcaggctaaaatcaagctaataaaaaagagagagaggaaaaaagagatttcagaggatactaatatttacaacaaagtttacaacctgttgtttgaatcatatgaaattgccaatagttgacctttcttgaactacaaaaatagctatttcatatggtttaggccaaaggttgaacactatggccataagccaaatctggcccactgcttctttatgtaaataaagtttcattggaacacagtcatgtcatatgtttgcatagtctcaatggttgttttcacgctacaacagcagaactgagtagtcatgacagagaccatataaccctagaagcccaacatacttattatttcaccttttacaagaaaactttgctgatccctgatttaacctaaaatgactggcagcaacagtaaaggcaccaggatttcagaagaagccaagatcaatgtaaaaggaatccttactagtgtgtccatctgagactccagacataaactgggacttgagaaagaagctgaattctaatgaagaaaaaaggctctcaatgcaacagttcaagctaaggacagaagggacaaggacccaggggatggcgaggatgataatggctgtactggcctttggccccaaataccaggagcacttgtctctcggagccttttcaaccaatctgctaacaccttgatttcagacttctggcctccagaacttcaatcactgggacacctcaaaatgcccccatttggttccaggtcctgtccctgctaaaatcctcacatgaagtagaactagaatgagaaaactttgataaggtttcagagatcaaaattctttgaacaccagactgagaaattgtatctttttttctttacgcatgaatcaatagaaggatatgtaaacagcatgatagaagagttatattaggaaaattaatttctgatagatgtgaaataattgagtctagagcaaaaactatattattcagaatatctattcctgtggccctttttagggttgtatgataaaggataattactccaatgattgcagtaattacactttaaagatttatagagagttctagagttgggaatccctttggggttattatcaaatagaaaagtaatcaaaaggagccttttctgcttcattaataggccacacattacagccaaaacataacctgctataaagcttgcattgtacatcgagctgcaaagtcttactaccaaatgcttcccagggatttataaatattgaaaggtagagaagaatttgcttgagtgaggaaagttctcctcttttccatttacttcaattatccaaaagcatattaaaaacatttaagtttaacattaaactagaaagccaagtgggatgtgttgtaagtaaattaatagctaaatagatatgtgcatgtttatcaacctgacattaaatgtatcttaaaccacatatataagagctgtcacagggtcatacagttcattgattttttcaaaactaattcacaggtacctttaattatgtaaaccagctgttcactgcctggtaaagacttcagcttgcaaagtaagaattatctacttagagagactgacctagaacacagttgctcccaattttttaaaggaaatggtgttacactgcagcaatttcttctcatgaacttgttagctatgagcccttgagccatcagcaactgaaggtccggagaagccccggagcagcttggcttcagctgtacattcacgtcccctagttcacattttgctggtggccagtgagacagggcctgcaggcaatgctcagagggtcaggatgctggaaattgccttagcactgtgggctttaggtgacaactcaagaactgggaaagctacccaccctactgggctgtcagtgacttcataagacaatgcatctacatagctcttgacatactcagtaaaagatgctggagtttttaacttctcaagctgttcccctttgcaatcacaaaaccaactgaaaattgatgttaatggtcattatcttggtgacagacatttcccagggtctcagaagggttgtatggcaaactccacctgggtatggtaaggggagtgtaagacggaaagtgtggatggaggccagggaaacacaagggatagtgcagcgacagggctagtcacagtgggctcagctatcaccttgaatcctgacagagtgggaggagtgagcacttaccaggtcccgagtgtgctgaggccttgggtggaaggatgcagccagacctaggagacccctcagagcacaagcccttctacctctcatcttctccatggcccccaagggaaaaagccaaccagaagcagagggctagcaagacttcaatgcagtccagagcctggaggaggctccagaggatctggaaggataagcagaagatgcccagcatacttctctttcttttttcctaccatcaagagatgtttgctcttatgcaaagtcaagcaacaattccaagccctggttttatttttagcaaattccaatttttcctctcatcttccttctcgctctctgtgtgggtgttcctgtgcaggtgaccaaacagaggtggcgattcaactgcattttgcaaagtgctttcaagtgaacaaagacattaaaccacacttcagcttgtaacaagaatttctatttcttgaatcatcacaaagtaatacttgctaacattatggagtgctcactatggaacaggcaatttacatgcattaacaatttctaatgttggcaaaacccctatgaggtaggaactattgctatcattttagaattggacaaagtggggcatggagagattgagcatgttcctcaggtcctcacagctaccaaggggcaggactgagcttcaaagcctgcaacctggatccaaaatctgctcatctaaccactacctttatactgcctcaaaattacagtgaaaaggcctagaagatcttgatatttaaagacatcctgcaactaatcttcttcatagaataaaaatatctatttttatgaaacaatcacctattttgtaatttgtaaatatgacatttgcacgtagcatttccttatgtgtccatgtgtcagtttccaaacattgtctttatagaaatgaaatagaatatgatcaacttaggtaagttcccactgcctaccaaagacttcagcttgcaaaatatgaatatctacttagtgagactgacctagaacacagttcatcccaattttctaaagaaaatggtgtcagccctcagttacactatagcaatttcttcccatggtctttttagcaacgaaccctcaagccatcagcaaccgaaggtccccaagaagtcctagggcagcctggcttcaggctacaagttcaggtccctgattacacatttatttttctgggttcctattcactaaacatgagaaatggggtgggagatggcattttccattatggcctcagcacagtctccccacccacaaattcttctgcagtgtgctttgccacttgcctgtccatgggcactctctccaaccccatgaatctgagccctaggactgctttgaccagtagaatacagtggaagtggtcctatgcctgtccttggcacagcctttaaagggcctagaaacgtccacttccagtatcgaagcccatgccttcccataaggacagagaggccatgtggcaggataccaggtgactgctactgcatgaggcccaaggagaaccactcagctgagcccagtccacccaaggaattgtgaaacataataacaaattgcaggtttaagtcactaaattatgggaaaattttctgtataccaatagatctccagaacaaatgagtttacctatttaatgcattttattttgggaagagggaaaaagataagagaactacattgtttgctcacattcccaggtagaacagtttcacctgggagccacgagtctctagatttcaggagaacctggctccagagaccaggcagggctttagggatagctggttcttaggtcatggtgattttatttgtaggactttgtacttacaagaaatccaaagagctaggcagaagagctgccttttctattctgaacccatggtagcactgtatccagatggttctggttatgaccacaagtcactccttccagttttgaaagcacaaccagctgtcagctccatcaaggtctgaggaactgccacccaactgtggccgtgtgctctagggatggtggccaagcctctggtgaaagggctacccacctgcacctgccagctttgcctctcaccatttccgccctgcatggctgaagcagaagtccccacagcctcctccccagctgccaggcttctcggcacctttcctagaggtcaggatcctacttggccagccctcgtgggcagcctgcccctgtgggaagccaagagcgtgacctgccctgcctggacacccaccagctgcacagctcctcccagtagcttccgggtatgggactgtggcctttatgtcatgctgagctacagagctgaaattactactaatatatttcaattaaaataaaataaaacatgtaatcttcatattccaggaatatttcagacattgacctataggcctctgccagccaacagtattaagacatctactaaactggggccagaattttttttccttcacattataaactagtaacatgctttcaaataccggactcctcctagtatttaaacccttataaaatccatgggtatatgaaagtaaatatgaacttagcttcctattgttcattcattctacgtgaagctcctcaagaagagggtgggggtaggaagtgtggaataaaaatcctttttggcaacctgagctattaccacattttctctccagtcttagaagactcagatcctcccttctttcatcttcccttgtatcattggacctgtagccctaggcatagttccctgaaacccaagtaccatcagatccgaaaggtgtcacgtggaaatagcctcaatacctggtgttcgacaaggctcagcagccagcacaggctctgaagagcaggcaaaggcaaggcagaggctgggaagccccagggaggtgtgcgggccgcgttaggatggacatttgtgcataactcttgccgctctgactctctgcctcctctggccatgttagatgcgaccatttccacagatacgttccacaagcaaagccagcaactgtttgctgtgttgagttataccatggagggacagatcatgtgttaaaaagaaaaaaaaatgtgcttacacatggttgcttgtgatgacagctgagttcagagatttccatcttgtatgatattcacatttttatatgtagtcttttgagattgcacagaatttgatggataattacagcataaatacatttatccaaattaaacatccaaaaagaaactacatgcaaatttataaactcttccagtctcaaccaacacactgaccaaataaataataaaatgttctttttttttattttaaagttatttgccaaaatgtatccccaaaccaggtgcttctctttcaggtttacataaaaggacaaaaggaagaaaacagaatagaagttaattattctggttcacaagcccttatgtaaggagaaatgattaattaattgcatttgcccacatcttgagaaatgcaaatagtctttggtattctgaccactcaactcagacctcagctgcactcaggatgcatctatagtgggcagtagaagcgaggagagatccttctccagagctcagaggctaatcaaggaatcttgacttgcacaatggaatcacctggaaaaggagctttccaggaaaccccaactcctatgctaaggagctacaaaatcggagggagagaggcgagaatgtgccgccagtcagcagggaagcctccttagaagtgagttataagcagcttcattacctgactgctctagctccaagtaccctcttcacatcttgaggcttttccattcccagaaaggtcagcctcctcttccttatcctgactgcaaagtgttttcaacactggaaaaggtcatcttgcaatgaagatgaataatgtgggttttgtccctaaaaaactccaggaagcatcttgcgtgggagtccttgtgagacctcgagcacatcagatatcaaggtctctgcatcaagcactctgaccagaaacagcccccagaacaaggtcctagagaggtgaccagctccaaacttctctatgatcctgaaaaggaagactgtaaatagttctatcttttctttggcactcttgagaccatttctggtcttcaggccacctacattcgtagggaactatatctgcagacaccatatcctggctttgtgtggtttgacagatgtggctgtgtaccctgagctggagggtcctctcagagccctgggcaagtaccaacagtgtatctgtgccagatgggcatgtacctttgaagcttccttcagccccagcaagtgaggaagctccctcagggcatgcagacacacaggactctttctgtcattcactgtcccacaccccactcttcctctctcctgctgtcactgcaattctgccctgaggttcctaggaaagcctcagggtttgattgaattgaacctgcaacattggttcaggtccttgaggcacgctggcaaaaaatggtatccatgccaggacaagggacacccaactggaaaacagataccgagagaggaaaaaccatctctagcctctacacactgtcttcccagggcagagcctagggtctgtcccagagaaagtttctagtaaatatcctgcttcatagaccaaatactaccatttaccctagtatctttgctggagcaagacacactaaaagcaaacaagtgatccaagttataatgggaccccatcataagcccctctctaagaagataatagatgaccatctctctatgaagtttagaaaaagacctacctgtggacaaagagataaattggaaaacctcagttgtgtcttccaggttctagaaatctatggaatgtttttatcaacctgaaggcagtcaatattcaatgaataaggcacaataattcaccaaatccatatccctttctttgactcaaatctatcctatctgccacatcagtttaggacaacagaaagtgtttgtcagaataaagatcttaaatatcccccccatcctcttatcaactacatattactttacaggtgaacaaaaaaccttggggaaaaacagtaatcaatgaacttttttttttttttgagacagagtctcgctctatcgcccaggctggagtacaatggtgtgatctcggctcactgcaacctccgcttcctgggttcaagcatttctcctgcctcagcctcccaagtagctgggattacaggtgcctgccaccatgcccagttaatttttttctttttttttttttttttttgtatttttagtagagacggggttttgccatgttggccagcctggtctcgaactcctgacctcaggtggtccacccacctcggcctcccaaagtgctgggattacaggcatgagccactgtgcccgacctgcatgtgtatttaataagaaggcatttctctagacatggggaaatgtaaatataattctttcaaagagaaatggtcatttgtctctccgatgattggggacgagtgttatcacagatcttttcacagagggcaactgtatcttccttttattttccacagataaaggttgccatgatagccaagccctttctccaccaggcttctcctttgacacttttttcatgtaaaccaaagagaagagtgaggggaaaaatctcagctgttctcctttatgctccctgccaatacaataaacatgtccttggtaggtattaatggtccttaccaccaaaagactgtcatcttctaatagcctgcaactgctcccaatttcatgcagtgttcactttgtcaagcacctaattccaaagcctccaacccccatgcttacaaatagaggttattcttttgttttctccaaagaatgaagcatcctttgaccaaagccatcaatcctagtgttagatttaggttgacaattgaaagatgttgaacacgccaattcgtctgagcccatgatactgtggtgtccaagataccatcactaattttggatcattggaaatattccaccacaggatacatttgaacttgttaaaaatagcccagctacccctctgaacatttcaacttactgtggcatcaacagagacatgctcctagttacaacattggcttgctcctctggaatgcaggaaaggagtcaaatttcatgatacggaattttcgagtttgtccataagatttttaaaatagacctttcactttagtgtaaaaggttacatacatagtaaaagattgtaaatatagaatttaatgtcttttctccaagtatgaacagaccatattgtatattttaggtataaaatattcatctaaaatattcagtatgaaacaattgatactattttcagaatactccctgtgcctccactctacttaaatatagagcatttaattaagtgaatccaattaatcatgtgaaagttaatgtgggaaaaggaaacagctaataaactcccaatggctcagagaagcaaagcatttcaaacatgcagactttacaagtttcctatgtgcctctaattatgtctttatacaaattcctttagctttctaccaattctgagaagtctaaggccaaattcttttctataaatatatctacaaaaactttttcttcccacacataggaaagacacaaaagatcgagtgagctggaacccgtggcccccttcctcatgggtttttaaaacatctgacataaactgcaacatatttgggccactgcaattatcaagcaaaaccgcaaaccagcagaagtcaaagtcaaccccaaaagctgtgttgaaaaagatacaccagcactcacctgaagaggaacaaagataaaagcgagtgaccctataaactttcaagaaagcagctttccctaacctgcttttgattagtgttcataggtttagccctgaaggcttaattaaacccagtagccaactctgtctcacttaaaagtgcaattaaagaatccacaaaggccactgggccctgagggcctcccacatgaggccccactatgagcaattcactaattgcgccctttgtcccccgactcttaatgatgacgctgccacacccccagtcaagatgcttattctccccacttagggccagctccaaaaacctcaaggcaggaagtgtgggcccaaaagcctgttctgcagagaacatacacttttaattaaacaacaacaaattaaaagctcattgaaaaacacttagcaacaaatccaaaactgcactaaagtccatgtgttaccaccactaattaaaaggactcttgattacagatcattgggtgtgatcttgtagccaggacttattaagggccatgatggagcccactctgaggggcaagccagccagtgttgcatccccatggaacatcatggtaccagaaagcggtcccgatccagaccccaagagagagttcttgcacctcgtgcaagaaagaattcaaggcgagtccataaagtgaaagcaagtttattaaaagcaaagaaataaaagaatggctactccacaggcacagcagtggcagtggcacgggcagcatggggcgggggttgtttagaattttatttggggtttacattgggcaagtcagtcttctcctctagccatagtccaagttcaaaacattgatttccttcagcctacctcaatagacaattcctcaatagatactctctttaaaaatgcctttcaggatttcaatggacagggcacataaccacagtgaagcctgactcttgtcctgacttgtgtaagacttcaggacctaaagtccaagcacctacattgactccttgaagttgtagagagcgacctgactgcaaagtcgggtcagggctgaatgaggtgtgagccccgggaaagcccttctgctcttcccacctcccagcttcatcctgaagatcctcgctgtgaatccttaagggctttcctatgcagcaagacaaacctcagggagctggaaactccgcaggtgggcctggaaaaactgttcaaagttaagtaacattcgcaggcgtaagctttcaagtgaatgaatctttgcgattcttacttgccagcttgcagtttcctgaatgatttcttttcgcaagctggtgatagaacctaggaattccatcactgctggcagacggaaagtaaatttggctccaggcctgactttcggagtcagcgtggaaagctgcaacagccaagatgggctgcctggacacgctgagatgctctctctatatggggcccctccttcccaactctcacctccactctcccaacccacccacgaccgctacacaattgacattcagtgtgacattcttaggtgaagaaagctttagaaaaaaatactagtttaaagtatgtgttgtttaaaaaaaaaatgcagggaggagtggatcggcagagtgggaatactttcaactcaaccacctgggttgggttcaggtcttcccacttgctcagcaccacctttgaggagtaaggaggcgaaggaagtgagagtgattcaaagatggaaaagaggggggcctttaagaagcatagcctggaaactccagatttttcccaccaggaaccaggaatgaagaagggagggaatctctactgccctgcggcaagccaggagagagttaccccacgggcagatgctggatcttcccaagctcaagagcaccgtccagtgtgatgcagacgtcgggatgtaactgaatagccatacgtgcctgtcatactcagaactgacttagatgtggtcctgtctataggcgccaacatgaaaccacccaggaacaagactaggagaaaaaggacacgtgctcctgctcctgtcatagcagcagcagcttgaatcccacagcaaagtggccagatgcttacagacacctgataatatcagacacagagcacaaaacttggtgcacccacttttacatgggtttgggggaggacggtttggctcaaaactttctggtgaacaaagagcataataattaaaattattttggtttagcagagaaattaaccagaggacgacaatcataaggagggggaaaaggaaaattcctctgatagatgggggaaaagtcactaaagggtatctgaagagcagccctatgcaaaaagacaggaggccaggcacagtggctgatgcctataatcccagcatttcgggaggccaaggtgggtggatcacttcagctcaggagttcgagaccagcctgaccaacatggtgaaaccctgtctctactaaaaatacaaaaattagctgggcatgatggtgcatgcttgtattcccagctacttgggaggctgaggcaggagaatcacttgaacccgggaggcagaggttacagtgagccgagatcgcaccactgcactccagcctggagaacagaacaagactccgtctcaaaaaagaaaaaaaaaaaaagacaggaaactgcagtctaggatttccctttccagtttagatcacccagacaccctgtcctgggcaaaggctcaataatatctggacaatggacccctgctctgtaaaacaccatttttcttttctatttacagcctggaaatattaaacttaaataaaatgtctatctttaactcctaggctcaagcttcaatgaagtttctcttcactgacactggcaaagatattctgattttaaacttcagaacagtgacaggaggacaggaggtgccgcagacacaaggcattggacatgggcaccctgccaggctgtgaagtgaacattcgaggcccttccctagcttctaacctgtcagaataaggttaaaatcccatacatcttagagtgtccaaaatcaatattagaggctaacatttggatgcttttcaaaaaagaaaatggttagaaaaagtagaaatcattaaaaaaaatggtctaatacattttatccacttaggacaatgccttcacataattctatacataacactatgagctgctttaattatgatcaactgaagctaccggaaccaatacaaatctatgattaaaggagattttaaaataagggaaaattaccttgctttcttaatccttctgtttcaaaactaaatacctgccctggtaacacagacatttttccaatcttgtaaccagccagtctgtttaactgaatggctaattagttatccttgaaatctagagaacattagcttgttgaaaatgaaagaaaaccaaaccacaaaaagtacctacctaaacagtattttattgactaactgaaaccatcaaaagtggtatgaaagataaaaatgtcacccaccccactgccatctaatcagcagaaggaaatattagtgtatcctcataaataactccttaccactcatgaagggtgataatttaggattggtaatagaaaaacatggtcgttctgtaaatgttactcttaatttgcttgtaagctaggcttcatgtttggaaagaggcaagttcaaagtgagctggtcagaaatgaccctggcaaaaggtcaataaagctattgcactaggacttaaaacgctgttgatctccatttttgtgaacaagtaactagaaatactgaagaaattaggcactatgaaaatgcttgcctgaagcatcacagggctggataaaaaaatactctattaccagtggagaaatgcatatgagtgctaaaggccagctagcctggaccacatccccaaagccatgctgagtgtatctggaccatggaccacctgtgccaaagtaaacactcccatggaaagccactatgtggaaaccaactggtgtgaggaaagcaaggtgcccacaagagagctgaggaagcctgtggcaggaggcagagaggattttaatacactaaacagatggaaggtgcagtaaacaaggtgggagagctaaagacactcacttctacccagagaaaacagtggaagagcaaggaaatgagaggcaattcgtatgtatctctacccaaaacctatattcagcattacattttaactgcaaaatgtgccaaagcagaatggaaagagctagaagcaattctttgattcttctctaagagcggggcggggggaggtgcgcggggtgggaaacactcccctttaaatactcaggctctgggcatttaaaactctgcattctgccactgggtctggctgttagaagttacctgccactccagctgaagcgaaggccttgctaagaaagtgtacaaggacacagaagcaggcatcatgaacttctcccccatcaaaggacagcaacctcatttgttgagcagaatgatgctaggagttccagactctgcagctctaatgagaccacaagattctgtgttgtcaaagatgttccccctgagctatgcccataaaacaataaaattggcagagaagcatactctaagcaatgactgggaattggggtgtacccaacattcagcggcgaggctggctgatgagtttaactgatttaatctggttatgttgtcgcatccggaaacaacctaagtttgcttgttttcataacagagatcacagctcagatagacttcccaggaagaaagtgtttcagtatcaaagaaatgtgctcatcctagcacccactggccctggcgctaagctttgtacaagtaatgtaaacacagaaaacatttcccagtagacgcagcaggactcgtatttaggccactggctgtttaatttactctaattttagagatgatgtccagaattttctttttaaaaaagttttattgaggtatatgttacatgccataaaatgtactctttgtaagtgtacaatttaatgatttttagtacatgtacagagttgtatgacaatctccacaattcagtttcttaccatttccatcacccccaaaaggcctaggctgcccatctgcagtcatgtccagttcccactgctagcccgaggcaaccactcacctgcctgccatctttatgggtttgccttttctgggcatctctataaatggaaatacatggtgtgtggtcttcagtgactggcttccttcacttggcacaaggttttgaggttcatacatattgcagcatatatcaagagttcatttgttttattgctgaatagtagcccattgtagggataggccacattttgtttacctattcttctgtttcaacttattaaatctataaatccaactacatgactaggcttattagtctgatcttggaaatataagaaaaagcctgccatatttttaaaatattctaggatgtctaaaatctctgtaatgtgtaaacatatgtaataaagacacaatatgttccctggaatttgtgtgcttggaggagagggtgctgttttaaatgagaacatccctgaatttcaatttttctgtgttttaatacagattaagtatcccttacccaaaatgcttgggaccagaagtatttcagatttgggattttctcagattttggaatatttgtattatatatattagcatttttagggtcatgtcggtgctcagaaagtttcagattttgaagcattgtggaattgggattttttgattaggaatattcaatctgtacacagaaattatatttatgctaatctccaagtcatgcaaggtcgtcaattcatttaacaagcactgacttactgtgcaaattgttgtgtattaggaactaggaaatatgcagtccctctcccaaccctccacctgccagtttacaaagacatttgtattttaagactgtgctaaaaaatcagtttggaggcatttggaacatttttctctaaataaagaatataagtagttttagagtccatggttagcccccaaaagtcttgcttaagccttagtcctttctctcagtatactctattgcagtctatactatatacatagtctctaagggcattttttgattcggtcacttacccaagatggcccgagagcctcctgcgtgccaggcactgttctaggcagcgtgggcaacacagctgcgaacaaaacagtctcattggtctcctaagctgacattctgtatcagtgaaagactttaagaaataaaggcagtgcgtggagttctgcaaaatgatatggagagaaggccgggcgcggtggctcacgcctgtaatcccagcactttgggaggccgaggcgggtggatcacgaggtcaggagatcgagaccatccaggctaacatggtgaaaccccgtctctactaaaaattcaaaaaaaaaaaaaaattagctgggcatgtggcggacacctgtagtcccagctgctcaggaggatgaggcataagaattgcttaaacctaggaggcagaggttgcagtgagccaagatcgcgccactgcaccccagccagggtgacagagcaagactctgtctcaaaaataagaaaaaaagaaaagaaaatcagtagttttacaacaaacctaaatctcagtcctgtaaaaggagtcacggaagccagttgtgattctaaaatccatttgtttacaggatgcccaaccataaatgtccctggcctccgaagcgttctctttccacagcaggtttgggggcactggcaggagtcagctgccttggtagctggctcagaacagctttgggggccctctgcaagacgtgtcacatctccggttttgttttgttttgtttttacagaaagaaaagctctttgtgtggaattttatttgaagtcactttgtgaggaatgccatctctgctgtgattcaggagaatagaagtttcggttttatgattttgcagacagatcacaggaaactgcttagcaaattttttcttagttgctttccttgactctgtttttctttccatgagtacatcatacatccttgccaaacattgggtggatttgaactgattgaaagaggctcgattttctgtgaacgatttgtccttgtgttatcctgattgtcactcgcctataacttacttaatttcacgtctcaacaaatatagtattatttcacccacagagttggcttctgatagaatcactctactggttatttatcatacatatctgtaattgaattacctattgcagtagtgtaatttactctcaattgtacataaaaatgtaacataaaataacatttttccagtgtatacttcctcattattctacatgaaccctagtttagccaattctacagaaatacagtgacaaataatgagtgaaagatgggaagataaaagattagtgggctcatgacctttcaataataaaagaatttcatcctctaaaaaaattattctcttttaaaatagttttttttccccaagtgttaatcaggaaaccaattctaggaaaccaataaggaaaaaaagagtttaaaaacagaatgattttcttttttccaaatgcagcaatactatgtcactacattttaaaatgtaggaaagggaaataaagtgtgcttgtctttgctcttgtcaaacaaccattaatcttggaccaaaaaagaagaaagaagatgacaacagcaattcctttgggaaatttttctgttttcttgatccactgttgtgtcactcctactttaaatttcatgcacaaggtgaaatatgacttgtctttgaagttgcctggcttcaaaatactctgtgaaatggacagcctggtttccttagctatacaaccttttagatggcaaagactgtcaatactagtatgttgaaataaattacctattatccaataccttctcttgggtcaagttttcatttgttttgttctattttgcttcaattttgaatcgaagcaagttttgagcaggttcatttatattgaaaagtttatgtatattctagcttactttaattttgctttttcttcttttctccctatcagaaattgattttgtatatctggataaccaattcttaaaaaattcatctgaaaaatatgctatatatttaccaagcgtacccatatctgtttctccaaagtgcttcccagcagccacatctcacctgctgaatttatccccaagttgctcccaatctatacaggaattggaaacaggagattgccccctatcatttctgcagggtagcagagtgataaaaacctaattttcaaccaaacttctgcatctcaattttaaaaggttgctgagaacatatgtgaaattatctatgttgtcaactgtactcaagacaactgaaagtacttatagacgctcattttatgattcaagaaaacagttaactttcttggtataaatttgcaagtagatgcaggtgagcagaaatgtacaatgcttcactttagacactttgtacttagttgtaactcaatttgttagacaccataatttacattttaaacattatttaacacataaaaacttgtcaccttggtataattataccccaagcaatttgtctgggtaactatagcaacaattgcagaaacatttttaaatacaaaattggtataattttagaatcaagaattatggaggatttattgcaggatgtacggctgctgtactcaaatagttgtacatatactactataaaaatggattccttgactgggatatgttataaactcatttgttctatcttgcacaccatctgctttgtagctcaaacctcttccttgggatgagtttttgatattagttaactctagggttcatgatcacttgtctacataatgcaatgcctttatactcttggctggacatttagtaaaggttttctgctcctcctccacatcttcctgtatcaaaagcaaaggctcaatttcaatgactttatgaccaaaaataaaatcacttgaaactcttaaaactaatcaccaagttaagtaaaactgtgtcacgattcagataggcagctctctctaacatcaggagcatctgacattgtccccaaagagctggcatctgttattttgggccactagcacacggtacagagaaaggcttgttggttgtaacatttgtccttcagcaagaggctaacatgactctggaactaaatttcttactgcaaatccatggacggggcttcagaaggcccatgactctaaaatttatgcagaagtttgtataaatgtgcttgtatttatttcggtctcgtggtcaataagttttaacagcctctgagctgtaagtttctacgtttcattctcccaagacacgtgatgaaatcattttaaagggaaacggcagtgaagaacgcaggtttatttttaccaaattctgaacgtctcaaaaatttcctctggacagagacaagctttaccacccaggaggccaaagctttactcgcagcagggatctcgcagctgtttgacattataacaaccaaatgagttagtgcaattcacaaaagacataaaatgattagcatcatctgtcttctccctgttaataaaagtacatattggctaaaagcacatagaaatagatgtcagtttgtcaaccccacacttcaatgagtatacagatgcttagtgtgactgcatggagcaacgtggatgagcaagcttctatctccaaagtttttacaagaaagaaactcaagggaaaaaacatctgtgtttcaagtgaaccaaacaattacacttagggctgtatttttcatgaaaaaaaaaaaaaaacatagaaaaagaaatcttttggaggggaaaaaaaaatccatgtttcttttggtgtaaatacaggcacagacaagaaaattatttcagttatacataacttaatggtattatctgcttgaactgaagttgtgtaaagtggtcatgataaacattacactctctaaaataatgaaactggcattaattagcaacaaattcagcaatcctaattaggtattgaaaaatctttcttattaaagcctggttttgtgtttctgtctccttatgaacagactacctctataattaataacatatctgctgattccaaactcagccattatgacagagctcttctcggtaagctagacgtaaaacttgtctttcttcaaaacaaaccagaacaatcatttgtgactcctgatgtgttaactaaagtacccctaaaaagcagaacggtattaaacaaagctcacgttatcttccctcaatttcgatttctttctgagtaaatgtaacagtcacaaggaaggcagatgcccagacaaggaagactttacagcgatctttttctctggaagagacctttctagttagagcatttatgtctggccaccacctttcctgtcccctctcctagcaaggctgacagctctctatagccaccagatcagctcccccaacccccggcccccaaaatgaaattattgcaagatctgcctggttctgctgtttgttgcctgggactcccgcccactcgcccaggacccagcaactgcctgtggcgcctcgtcctccgagcgctcgctcgcagcgccccctgccgggaatcccgaggacgccgcaggcgcaggaaagttaaatcccaactccggccgcggcatcctggtacaaagcaagcaaagggcgaggaggtgaacgcgcttcccgccaaagccaggggaacagggatgtgaccgctccaagccaggcaccggccgccgcggggagcgagccgggggaatcactcctccacgaccgttcccacgcacatcttgggagaaaccattccctctggagcccgatctgcccgaaaccctggggtctgaaaccctgagccgcggtgtgcaaaatccgtggagcagcggagggatgcctggtgaaaggggctcgcctagctgcagcgcacctggctggtggttccccaggcctctgcatcccccgccttagtgtctttcattaaccaaggcgcttggcggagttgagcccaagtcccattgcctcccggttcccctgtaaggaaagcaggaaaacctgcccaagccggtggggctgcgaggtggccgctcccgaaccgccaagtcccgacctccgtgtcccctgcccccggctcgcggcagtgcgagcctggaggcgcgccgggggcgggcacagaccagtgtgcgcacctttccgggtgttgggcaggggtcccgtctcgcccaccgcgacactccggctccttacctctccatgctcagacctcggcacaggcgggtacacaaacttccagcccgtgcactagctcaactgtgggcgcccccggactgacggtcgtcctaatcctgtacgcgcaacccccgcccaggtgcctgctgatggatcccacccgagatcggcaccacccaccagccgaccgctgcagtccccgggtcccggccagcggcgcggcgcggcgcggcgcggtcaggggctcctgccaaggccacgcaggaatcgggcgggggtcgctcaccaggtgcgaggagcgctggtgccagtcatccagcgcctgggggccagagcggctccgaggatcctcttcagcacctggctagggaagtggaggcagcagctgcagccgccccctgccacttccccagagccgccccctactcgctgagttccagaatgggggcaccggcttgggggccacgagcacggtccccgagcgcgcggccaaccggtgggtgggcaggttcgcgcccagcagagacgaccctcgaggtggcaaagttgggtgtccaagccagctccgcggggcagtcctgggtgggagaagggagcgtcccgggatgagcgacactggccgggccgcccctgcacggggaaggtggagggccggggctgcagcgggccaagggccgcggctggcctgaggctgcgaagcccacccgcggcgggaaagcagcgctcgggagcgggctcagggagagcagccgccaccggcgccgccttcccggcaagtagatcggcgcggggcgagcgggcgcggagagcgcggggcggagagcgctgggcggggagcgggggacagcctgggcccacccccgccccgccccgcccctgccccgcccccgccgccgcgccgcctcctcctcctcctcctccccgccggggtgaaactcgagcgccccacccgcgcctgacctccccgagcccctccccgggccccgccccttcccggtacaggacccccaccttcgctcctgggagccccgctgcaccccaggagttccattccagcctccccagtgcgagtgcggccgagcgctgacttttgggggctccctcccccgtctcactgggtccctctgcggctcccccgcccgctgtcccggttcagacgtggctgcaccccggaggggggcgccggccgagacctgagacgtggcgctccctctctgccggcctcggcttcaggtacgtgcggttccctcggctaaatctggcccgggggatggggggcaggggccgtctggtcctccggaactcgaactttgtgattttgttctttctgtgtgacatcctcatccgttctgagggagaaactccttaaagaagacgagagagtcagtcgttgcgggttcttggaggagcactttgggggtgagactcccggctagttcgggtcgatttcagcgggattaagtcaaggaaatgaacaaatctgacgaatcagggaggccagagaaggcgtccccaggtagccacgctgagcgttaagagagaagtcccgtatggtcaaagtcattcgtccaattctgtgtcaattattccttgttgcacttttgcaggatccttgggccttactaagtactcaggtgaaaagttgataattgggaagcaagtaaagtacctttgaagacgtgtataattggacactttgttgcagttcttcagtttctggaggaggcggtggggggggagagggagggggtcagcctcgcgaaaagagcaaatggtaaagttataggagtataaggcataaaacttgggttgggagtcctgactggccttgagtggccctttcccactggatgggggtgcgggacagtatctctgggccctttttactcagtctgcgcctcagagggaggcttgaaggtcccctgcatgaggaaatgtgtgaattgccccctcctgaccgcagtgaggtagggacccccgcaaggacccacgttcacaccagcgcccttccagccagtggtggggtatggatgggcctcgctggtcctgggcatggtccggtgcgtccataagggttccattgagctcatccataaaacaaagaagctattgcaggctgcagggtgtcatagctcgcacagtagccatgcagacctaagaggacaatggaaatacaaattgctatcgatgtgtctttattttctagaacttttttttaaaataaaagaattaagtgaaagcaattccgaaggtttctatgaaagcccagcccatccccaaatgcccagtctctggcacgggtgatctggctgtcttgggtactcaggccttactgggatttcctttaagacctctgggaggaagtgtcagtagctgggcaggccttcttggcaagcattcctccctgggttgtggcgggggctcccggcctgctgtgtggcagctgcaggctcctggggacctgaaggaaaagcttaaccgttctcccttcccttgcttggcacttagagcactagttccattccagacattccgattatcttgcctacgtggcacagaggcctaggagcctccctgggaggaagaggcaggccaaggtcttgcctggctgcttctagggggaaagatgtagggaggaagctgccttatgcttggatctgcagcctttgcctggacctgtggagcctacgtggccagggtgagggagacagaaattagaacccaatgtattcagctaatcctcttcttgcctctgaacattgccgttaatacttgaaaagaaaaaaaaaaagcaaaaaaactcttggcatatagagctaagcagtgggaagaagatagctttctaaaccatgacccaataggtctgataacataacatttaactggataaattacataattttgtatatatgtaggggggagttgaattcagttttgctgtttacaggctgcaccaatgcattgttaaaagatgtatattttagtgataattgtgattaattacaaaataattgctaataagcaggtaaataaaccaaattataatttagagtgcatcctttgtttaaagtgaaatggatctaaattgaggatataattttgagttttaatctggggaaagttctttaacttttctgagctacagtctcttcacctggagcttagacacaccagcctggcaggggtatgtcagctgtctgcttgaaaggagaaagacagtaatctgtgtgaaatactcaccgagcacccaacatataagcaggctcttcataaagtcattttgaggtatccacaagtatttcttttttctaaacaaaatttctttgttttttgtttgttttgctttgcaaaggtcttgcttgctagaaagctatctgcattaagctgcttctcatcacattataaaactaaggatgatcatttttaaacaaacaaaagtatttagttatcttttcaaagtaaaatatagctttccctaaactgttttaggtgagccatgcacacaatgtgaaagaatgaagaaaccaacaaaacacttggtgaaaatgatgaattctggggcgctgattcatgtgacttgaaaaatgccatccatttcctgattcacctcaattctgttcggaactatgaaagatcatttatgtttctgcactaattgaccaattttgtcttgtctttacttccctccctagtgcttgaatttcagccacatccctaagctgccatctcagaccagaggaacagggaggggggctttctggaaagaacatcacctggaagaaatcaggacatgactgtgggccatgagtgaccttcaaaggaaagccgggtatctgtggtctttaagatgtggtaagattgtattaaaattatagaaaaaaacctcaatccagaaatcgtggcctcttgacatttacatcttaactgcattttcctaccaatgagatgcattacaatcatcctccataagtgttctctttttacccctgtttccattcttttagatccatgacatttaaaaactgaagaaatggaaagatcatctgatcaggcccatcagtctttttcctaatgctaaacattggtacaaagacgtgaagtttgatgtctcactaagattgcctagggctgctttattgctcacctacttcaaagtattgggaaaacatgattatgggtacaggtgatgctgtgttgcccccagacaggtttcttttgtcaggttcttttgatggattaggaacctacaagtggggagattttagggaaatagcccctccacttggatttcaccaaaacgtctttagggttctcttaccccaagaaacacgcattcctctttagtgtggcagcccactctattggcaaagttaagcagaccagttttactaaaaaggagccacccagaaacttagacagaaaatacttgaggcacagatgagaatgagcacaaatgtgcatagcaagtgcagtttcctggcccttaaactgaagggccaggtcagtctgctcctccaggcacagcctgggaccccatcatgtgccccactctgcagtctgagcttccactcaagtccaccagggcctgcctcacatatatatacaagacccaatgtcagagtctgcctctgcccatgtctggtcagagggttgcactttgccactgctacatgttcccagaggttggcacagcatgacctggacctcacctaacccaggcaaactctgctcatcttcgagctctctggaacccatttctcaagggagaaccacattcccccacctcacagccaagttcaaggaagcagcctggctaaagcaatgactcaaggataccagaagcagagcacgcatttaagaagatgcgctgactcgcaggagcagctgactcttcttaagaagagtttactgattcttctttcagtacgggccttttaataagatattgtattttacttcagctatgggtgcagacaattaaaggattctagaaatctgaaagtgttttgccttgtcctcttggttaaatttctggatatattgtctagcaactcaatttgcttaaacaaaattgttgtgtcaaaaaagcccaagtcatcttttataagtgtggtctggggagaagaaaaaaatgctaagtttaaaagatttttggaatatctgaagaaaatacagatagcttgtaatggagatgaagcctctggatggtttccagggtgttattttccgacattgagtcttgtatatatcttgaatgtctataagcaaagaatggctatactgtttttaaaaagatatgttttatacttattaaccaatgtcctctctattcctctgcctttgaaaatagagctttgggggaaaataagtacctttggaaatatgttttcaaaaataatattcatcctgcttagatttagaagcacagattactctgccttagtttacttcattatttaccagagagattaactcaaaataaccttgagttaatgaaaagatgattaagtgaaattaaacccaaaagtaaaatgtctcctgagcaaatccatagaaagaagagccatcaagcatccagtgggccctccatcaagtgttgtttcaggccctcctttccaatccattctcattaccataattcacagtgtcagtgtctctcacccaaactaccaacacctcctcttaccgtcttcctgactccagttccagtgatcattccccaatcagcagcatcacacccacccctcacacatacatcatcatcatcatcattaccgttaataacacagacctgattttatttgaattggaaactacttggctttaaaaaaaaaaactcccttgcagctaggtgaggccatagaactcagccataaccaataagatataagtggagtaggattctaagataggctttgtaaaagggggcagacaactaaatgggcatggtctttcctgtccttctctcctacttctggattcccacctggaagttgattgtgatggtggaaataccaggcactggtcgggtgcgatggctcatgcctgtaatcccagcactttgggaggtcaaggtgagtagatcacctgaggtcaggggtttgagaccagcctgaccaacatggtgaaaccctgtctctactaaaaatacaaaaattagcctggcatggtgacacgcacctgtagtcccagctactcgggaggctgaggcaggagaatctcttgaactggggaggaggaggttgcaatgagccaagatcaggcacctgcactccagcctgggtgacagagtgagactctgtcccaaaacaaacaaacaaaaaatgaaatgccaggcaccagtttaggctcttgaggatataagttatgagccaaggatgatggtgtaaaaagtagcctaaatccctggtgactccatggagcccctgcctcagccctgaattacctaaccccagacttcatgacatgagaaagaaagaactttctgttttgctttagccatcattgtttctgttctgtttttagcaggagaatgtgattccttaccaatggaggggattcagttcctccaggtctggcaaccctgcagcttgggtccagtttcatccctcaacattgcggcctatgcagccagtgccccctctccctttctcccacccagctttcccatctgcaaccaagcttgttgcacaccatgtgccagacgcatggctgcacattcaaaatagaatgaaaagacacacaggcgatccctgccctttcagaagttacagcttaccgagttacagcttactgagttatggaacccacaagtatgtaattctaaaccctgataaatgctatgaaggacaaatatatgggtgtctggtttagtatggggaatgggagaggcatcactgaaaaagtagcatttgagatgagatttgaaggatgagtagagaccagcaagaaagtgggaaagataaaggataagagtaagactccagaaaagggtggaaatggagattaactttggaatttaattcaaacacacttgttaacatatcaaggattgtaatagtaattgcaaatgaatagcaataaatactgtcatagtccatttcaggctgctataacaaaaaaccttaaactcagtaatatataaacaatagaaatttatttataacagttctggaggctggaaagttcaagatcaaggcaccagcaggttcaatgtctggtgaaggcacagtctctgcttccaagatggtgccttgtttctgcatcctctagagaagaggaacactgtgtccacacatggctgaagagctggatggagaaaagggcccagctaattccctccagcccttttataagccactaatcccacttatgaggtcagagcccttatagcctaatcacctccaaaaggccccacctcataatattgttggattgaggattaactttcaacgtgaattttggggagaatacagtcaaaccatagcattcttcccctgacccctcaaaattcgtgtcctcatatacaaaattcatcccaaaatcgataacttattgcccaaattcttaacgtgttccagcattaactttaaagtctaagtctaaggtctcatttaaatatgatctatatcagatacagctgagactgaaggtacaagtcatcctaaggcacactcctccagctctgagcctatgaaatcaaacaagcgatgtgcttccaaaatacgatagtggtgcaggcataggatatacattcccattctgcaagggagaaatgggcaagaagaaagggtcacaggccccatggaattccaaaacccagcaaggcaaactgttaaatcttgaggcttgagaatggtcttgagtccatgttcatccttccgtacacactggggcaagggttggacatccaagggtcccacccgccctacccccatggctttgctgggcacagcccatgctgtagctctcacaagttggagtccagtgcctgtggctctcctaggctggcattgcacgctggtggctctaccagtttgggatctcagaggcaaccctgaccccacagctctgctgatcattgtcctagtagggaccgtctgcacctatctcacctttgtggcagttttctgtctgggctctgggctctccaagacatcttttgaaatctacgtggagacagccatgcctccacagctcatacactctatatacatgcagagttggcacttcaagaatgtcatcaaggcttattacttgtacctttcagaagggtggcccaggccacatctgagtccacttgagccccagctggggcagctaaaaagcactgtgttagaatgcggggagcaaagatctgaggaggccctaggcagtgaaacctgaggtgccatgggtgccctgggcccctcccttgaaacctttctgacttgaaggccctggtactctgggatcatgatgggagcggcagcctcaaagattgaaatgcctttggagtcattcttctattgtctggataaatagcatctggcttccttatagccacactaatctcatatcaaaagttacatttgcttagccacgcccttggtattctcttctgaacatgccctttgaatctttacaacctggcgaggctgaaaattttccagatctttaagttctgcttccctttttattgtaaattccatctttaattcatttctcttctcttgcattttatgataagcagtcaagaaaagccacatagtaccttgaacaatttgcttagatatttcttcaccaaatatcctagtatatcactcttaaattccaccctccacagagcactagaatgcggacacaatacagccaagttatttgccactttataacaaagatagcctttcctccagtttccagaacattttcatctgagacctcatcaaaatgacctttatcatccatatttctaacaacatttttattacaatcttttacgtaatctccaagaagactgaggctctgtctgtaactcttcatatgagcctttacgttttacagtccatttatggcaatctaggctttctctagcctactttgccaaactctttccgcctctacccattacccagttccaaagctgctcccacattttcaggtattcgctacagcagcaccccactactcattaccaatttctgttttagttcattccaggttgctataacaaaaaccttaagctggttactttataaacaatagaaatatatttctcatggttcttaagactgagaagtccaagatcaaatcaccagtaggttcagtatctggtcactgcttccaaggcaaaattaatccttattttattatcagcattccagtgaatagaaaaatcataggccaaatactaacaaattcaaggatgttttatcattagaaaatatgctaatataaatcacctcatcaacaaattttaaaaatgattatttcaatagctgcagaatatgttttgataaaattaaacgtgtttgtcattcaaaaaaaaaaaacctcttagctaactagtaatagaagggaatttacctaaattgacaaaaaaaaaatcaccaaaaacttgttatttagtggtgaaaagtcgtaggcattcaattgaaagagaagatcaagacaacctgtactttcaatcactgttgttgaagagaaatatctgtaaggacaaatcaaacctccttatggatatttctcttcaacatctaaacagtgattgaaaagggaaaaattaacttttagtttcagatgatataattgtatctaataaaaacacttaagtaagtctgcatatcaacaattagaataaagagaaatttctattaagttctgaaagacttttgtgaaaaaaattataaagctaaatttaaagatcctaaagaagaccaaaataaatgtatgctattccacattgatgtattggaagattcagtatacaataccttgaaaataaaatattcattcagaaatatccatgatacccaaatttatccttcaatacgatgtacgtctaatcaaaatctcaactggctttttatgaaacctaagatcctaaagtttatacgcaaagcaaacacaaatttccatgagtgattaaggaatgtccgtagattatgaacaaggttgatgagtatcatgtcaatattgttcatagggctatagaaattaagacattgagatattgacccagggacagacatagagaataataaatgaagcctataaacagacccacatagactccctcttgagtgacatgtgacaaaagatgtatggtggctcactggggaaagaaggtactcaatagatgggcctaagacaattgactacttatatgtaaaaacagtgaatttgtacctcccccttaagctttataagaacaactttgaattagtttacagcaaaagtgagaaacaaaacattacttaggaaaacatacaagacactatctgtatgaccacaggatggggaagcagttcttaaaacaatatataaagactagccataaagaaaaaaaaatcaatacggcaaacaacattaaactttagaacttccatatgatgatatacaacttaaaaacaagccatagcctaggggaattttcagtgcatacaaatgacagaagatggtaggcaaaatatattttcaaagtcctaccaatccatttgaaaaggacaaggcaaaaactgtacaaatgaaacaagaagctcaacggccaataagtgtaagaacgtaacacaagttccctaataatcatggaaagtcagttaaaaccaggaagcatcatttcataccagattagcaataatgaaaaaatctgacaataccagctgttatcaaatgctggcaaggggacctttagaggtgtaaattggtacaatcacttgggaaggcattttggccactcttgcaatgtctaaaatgtacattccctgcagtgcagtagacaaggttgcagaagggacatgtagtataccgccagtttatataaagtacgtaaaccaaaaaatcagatctatattgtatggatacatcacagtagtaaaatagcacagaaatgataaaaaataaattcagtaatatgtcaagggagggaaaagggggattgtgcaaagatcatcaaaggccaccaactttatctttgattctgttttccactaaaatgaaaaaaaaatacgcagcaaataatgaaagatgttaagatcagacagatatgctttggtggttcattagattattatccttttctgtatgctcagaagatttcataattcaatagagagggttcataggaagtaagaaagtgcagacaggaggtggaaactcattagagcagttttgtcctgaagagaaacaaagaaactggtagcagctggacctgtgcacagagggttatattccacagtgggtcattggaagcatgtttatatgttggttgagataactccatggatagtaagaaagtgtctacataatagagaaataagagaactccaggaactaagactttggaaagataagagttcataggtgttcgtttggagacagtagagccccccttgaatggtcattggagtaggaaccagggagaccaggtagaggcagaaatggaatcttcagtggtgcaaattgttccagggcagcatgttttagtaatgaagtatgaggctagatttgggtgggcagtagggaaaagacatgaacgttagaaaagattagagaaactataaaatcaacatcttggaaatcaggcaaacaaacttactgggagtgtgtactggaatctccatgctgtgttggacgaccagtcaaggctcatggtcatcaccctaaagtgaaccccatcagcatgtttgtgagattttctctaggaacattcagtagctcaggcacaggtgtggataacatggatgattgattccaaccaggaggtggtttccccagacaaacaggagagaggaacagaaaagtcgaggatgtctgtagggaggtgactttaaggatggtcacacaacgtaagctaacaaggaggacacagggacaaaaaggatcatggtttcaacagattggaggactagatgaggtccagaatctgaaagtttacttgtggtccaagatgtgttcgtgataataggggctgcagtggaattactgttgttcaacgagaggacgatcaccagcatcttagaggggtgatcagtatagatgtttaagtcagcagaaagaaacttcagtgaacgaagcaatgtgacacaggatgttcaacagacaatagccacaagcaaaatcattttatagatgttgaaaatgtggttcagagaatgaacctctacaaagcaaatcccaaactaataaccgaaggaacccgtgagtatttgaccccaaactccattctctttccagtaccaaactgcttatacaagtttcaacacagtaaactttaacaattatacaatggaattttatcttaatctccaataactcccctcaaaggagctggggatgacccttaaccagtatgactaatcagaaatatctggggaatattttcaacatacacaagccaaggctgatgctatacgtagtgaatcagagtctcccaggggtggggtccaggcctgtgatttcaaaaacattccccaggtgcatctgacgcacagcctgttcaagaaccagtggacttcagattattttcagtaccaaaactcacctgtttttaaagcacagatcattccaatagtcctgagaaagaactggaccaagagaacagactttagggcccagttgtatttacctggccatctctaatgtctggaattattgttttgtgtgccctatatagaaactcattccatcttggactgtattgagaagcatgtttttctattcagtatcttatgtaatcacaaaagagtcttagtgtttgcttactgtgctcaaagattcacttgtatcaatttattgataaaatacccacttttatcaatttgtttttataaagtgttttgcttgtcagtaatgtcgtctgcaaaattctcattgccagatgtattactttagggactacgtaaattatggggggtttctcgctctgtcactcacacaccttttctcttctgctaggatcagctttcacagctgtgtgcatgggggaagggccctctctgggatatgaactgaggaaggacgccccattgacctttgtttcctctctcctaccccaacctcccagctcaatcagcacagacatgattatgtaatcatgccaatataagagccacaattatgtttacttcacccttcccctacctctaggagataatatcatttcaactcacccagggaaatatatcagaattttggccaactgcagaaatagcctatataaatacactgctcccagaaaattctgccacaccttccagcctccaccaagtcaaacactgggtgagctggactgccttctatttcatcccctggattcttgtggggtggggtgtgtggacataatgtcagattcatccctatgtggtgacagtatcaatgaagttataaatatctaaggcttgtggcattccctagcgaagtgtctcacaatatacctttcatatatcaataactaacaggttttgagtatttcctgcttgccaggctctggtctaagaggtttaaaatgttaatgtatcgacctcttgaattaactgtctgtgctggggaatgttattacccccactttatggataagaacattgaggcacagagaggttgagtaaattcccccacgatgaaacagctaggaggcataattgggagacagacagtggcatagctggcttcggagactggctcttccccaacacctccatggtgcaccagggccagggttgacaaactttctccataaagggccagagagcaaatatgttaggctttgtgagccatacagtctctgttgcagctctagacaatatgtaaatgaattgtgttccaataacaatttatttacaaaaacagaccagatttggcctccaggtcatagtttgctgatccctgctctagcccagtggttctcaaatttgagcatgctttaaaatcatcagaaggactttctaaaatcagattggtgcccaacaacatcctgagtttctgattcggtgggctttggatggggcccacactttgcatctttagccgttcccaagtgatgctaatgctgtggatctaggaactactctttgagaaccactgcctaaaggaacattaacaaacacagcttgcaggttatcttctgaaagcaaatcaacgttaatgtaaaatcttaccattcctctaagtcatgatgacttagagactcctttgtctcgcagtctctggacaaagaccattttttatcttcttggtattcacagtgtctgagatggtggcttctgtgtcctaggtactcaaaaatggttgctcgtggaatgaaactcaaatgaatgactgtaatgctatgttaggtcgttcccattaattttaaaatgtgatgaaaatactcaggattggagtaaattgctctacctcagagaatgacattacctaatataggcaatttgtttgtatggtatagtaagtcatttttcccagttcacgcatttaaagagaatatacaccttaagatagccctgagtttttcccaagtcacattaaatgtagcctgccccaagttatgatcctacataagaagcagctcttgtttgtcaagatactgttccttagagatgaggtaaaaaagaagtcgtaggttatgggattttacagaaggcattaccagtcccggcaaaaccagttcttaaaaaaagattaggatcaggctgactggacacacctagatataacttgagcagaggatacctgccaggactgatttcccccttgggtaaacagccagatgcaaggcaatgcacaggccatttaaaatctcagtgctgtgactgaaccagagcctcgtggttcactttatttagaaaaacaggtgggaaattaaaaatcctccaaactattttgaattggaaaaagaaaacctcatttggtttcaaagcatgttttttttttttattttttatttttcctaactctgagaaaacgtgaacactgcagcgagtaaaaagactgctcactgccttccatatacacaaatcagggctttcctgcatccaaatgttactttgaactgacaaaacactcttggcactttaattttatttcataacgaaaaggcaaacttaacttctaagcatttttattccaagtttaatggcttacattcccggggtcagcaagcagatggagttggagacgagaatgtataattgcagattatgaaacagcaaaattaatgttactttgttaatgtcaagataggatttgagagctagaagggattttcaagatcattgatcctaaacctcatcatacagatgaagacactgaggctgaagtgattatgtgtcctgcccagctttgcaaagccagttggggacggagctgcatctgctgcctggtctcctggcaattaggccagtcctcccactgcagtatgccactatcctcatcagttccttacaagaaagaggctcgtatttatccttcactgctttacctttcagtgtagaagtgtgtgtgtgtgtgtgtgtgtgtgtgtgtgtgtaataaaggggagaagaagaagaagaaggagaaggagaaggagaaggagaaggagaaggagaaggagaaggaggagaagaaggagaaagaagagcgaagagccagaactgttggcttgcaaccatctgcaaatttcctagggatgtggctccttctgtctgtggctctgccattctcagtgggctgcccacatcgtcatggtccatgattaaccatcatcttgaaaattccagccaggagggaggagagaaaggagaagtggagtgcatacttttccccatacaaatgtgccctggatggcacacatgcacttccttggccagaacttacttgcattgacagacctagattgtgggtcaccatgcacccagctaaatatagtatatagtattatatccaatagaagaaacaatggtcactgagggctacctagaggtttcttagttgactccctggccatccaatatctgtgcttacctttcatctcacataaagaacacacgtattccccacctaagggaggcaatctctgtatatatcttattgctactgctttcaccttcaagttcatgatctgtacctgacacacactgttattcactgcatccaggcttcctcctctcagttgaacaactgtaaactaaaagacaagttttctgtccacccattggatccaatatagaatggtagagtaggaaaagaaacttcagtggcagacaaatggcagtggtggatccctgctaatgaaggcatgcttcccaagagttccagctgtaagagtgaagtcactccatctggtatcccctgggaaactctctggaaggagatcactaggagtgtgtggaagggtgtattagtccattttcacactgctataaagatactacctgagattgggtaatttataaacaaaagaggtttaattgactcacagttcctcatggctggggaggcctcaggaaacttacaatcatggtggaaggcaaaggcaaagcaaagcagcacgtcttacatgacagcaggagaaagagcgcttgcaggggaaactgccagacacttatcaaacaaccagatctcatgaggactccctcactatcatgagaacagcatggaggaaactgcccccatgagccaacacgtcccaccacgtccctccctcaacccatggggattacaattctagatgcgatttgaatggggacacagatccaagccatatcagagtgcattgctctggttcagctggggcacacagcctttgccactcacccccagcagggtggcctgactcacgcccagcagggtggtctgagtcaccaatcaagcttgtctggtggcttctttggcaacacaatttcctcaaaaacttagcaggcaactgtcatttaaacctgaagatttcgcttctttatttcctggcctctgggtactgccaaaagtcctctcgagttaatggtgtctcccttgggagtttcagtaacatagtctttgcgggaagtaaatccccttattctggtctctcattttttggcagaaaattccgtatgtgagaagacttagcaaaataggatcacacagttctatctcctccccttgcagtctatttggagccacctcttctcaccgtttcagttttggataaggtttggctttatcaaacttgcaaagtcccaagataactcatattcacttcaagttgactatgtgagccatgaggatgttcctgtcatgagaggatctaacttagcggagctctggttctctttcatttttgcttgatgtccagccgcctctagcataaattggcctctctcatgaggacttcgctgaaagtgtcaagtgtcaacaacaaaacatcaacattctgaattttctgatcatttcccctaatgttggtcatgccctgtgttcttcatcccaagatgctgcagatgacaatgtcattagatgctttgtccctgcataacaagggtcaccagctttctacccaccaaaatctgcatttttgctgtccactgtccagatgctttctctaagacaatgacatcagtgtggccagctggattctaacaaatgccacgcacaacattctcttccaaataccaaattctgccatatacattcagctgtgtatgagaatgatccaaatttgcagtgacctaaacacaaaatgagtttattgctttctcccataaacatctaatgtggtaactgtgctctacaaggtcatggggtgctcaggttccttctccttgtcattttaccacgccttggtgattttctggtttctatggcccaatatttctcagcaccatatctgcttttcagccaataggaggggagtgagatggttggtattatcatcttgcctattaagtaaggcacaatttggagatttcacgcatcacttcattcaatcccattattcggaatttaatctcaggaataaacttacttttttaggatgtcagagtccccagacaagggtttttattgctaaagaagtagaggaagtttatattgcagaacatgaacagtctctgctgcattatgtacatctttttaatgttcagcataaatatctagaacacaacctataattagtttaaagatgtaattcagcatggatatgctgtttacctctaaatctccttatctagaatattagtgaacctaccaaccaggaattcttgggaaatttcttatccaaacctttaaggttatctgatcttttgctgtcatttcattttcctctaactcttccaaaatgggcatccacacagaattctgtcagaccagcatttgatatccaaaatgatattaattaggtgaataagtctttatgtaactgttcaaactccacattttggatgtatctggtttaactcactattttaacttgcccattaagcttctattttcaatgaacataatttttattactagaatttacataatcttttggcaaaatgttgaacttattttctgttttctgttgtgtcattagtatctcaagcatgctaattttttagtcgttatcctattattctcatatctgaatctactgtgttttctgctaattttcgcacatcgtagcctgttctttttatgatttttaaaagtagattgtgagtttgtttgctctgtggggctttatgaaaatcctgagtgtcctggattaaaagtttccctttcctagaaggttctggacatttaggagtggtaccacgcggggataaatttttgttgttgttactttcctcctttgggggctcccaagtatagtcacatcaaactaaaaccttatgagagaaacacttattatcttaagggaagagttttttccaccaagatcccagaagacaatctctttgttatctatttgctggtgagtggatgttttacatgcctgttcaatagggctgactgtactgggatgggatgggatttcaccacatcatcatgcatgccccaaggacttatttcctctgacccctaaaatccatgcctatggtcgttggttaccaagaaaggcacaccctgtttccccctgctccccacctccaactcacccaacacaactgaatgaacatctattctttattttgtggccttgggaatttccttactttcttttgagcttagctatgtatttcaaagaagctgagtttatttttttctagcctttctaggtgttctgtagtagtatagtttcatattacttaactgtttccataaagaaaagtcagctccctaatttcatccatgaagttgcaaactgttacctacttcaacctaataaatcgcaatggaagcaacaggaaaacaatatttacaacatttgtgagggacaagtggtcagcatacttgtataacgtggcatatctggctatttaagctggattccagaggctcttcagtacaaacagtgactctacctctccttccccagcaactcactgtgttgcgcaaatctcagtaagagtttacactctctgctagccccagtaatagggaaggcaacgtggatgggaggcatgaaaaaggcaaagttcaaagaaggaggtctacatttgtgctcctgtattttaggcaagaccagaagatatggggggactcatgactttgaaagttcatgagaaactttatgagactcacaagccctaggagaaatgcttctaggcctaggaaatcagatatagtgtaaaattataaaaaagagcatattccctatttctggaagcctggaaaattcttttttttaagacagggtctcactggctcatccagactgaagtgcagtggtatttcacgactcaccatagcctcagctgcctgggctcaagcgattctcccacctcagcctttcaagtatctgggacacaggcatgccccaccacacccagccaatttttaaaattatttgtagagatgaggctggtctcaaattcccgggctcaagcgatcctcccgcctcagcctcccaaagtgcggggattacagatgtgagtcactgcatgcagtgtggaaaattcttgcaacattagaacaggcatggcagagtttatgggattggcaccactctttttccacccaagagacgatagtttttctgttgacttcctcagggtattcttgactgttggtggcagcagtgtggcttcccaatactgtgtcttgacagtagacaggggcaagtgggagccagcgctagacgcgcagaggaaggcagacagcaggtgggatgggagctcaccaactgggctcgttggctcgtgtgaagcactcctttggggactcccagaagtaactcagagaaaatgctttgtagggagctaatttttagcaatcaggctaggggtcactgagctcccataattgattgagtctctaaagttaaggggactttatactggcaagatatgggtagaccatgtgagtgctgctaaacatataaagagagttcaagtgatgggcatttagggtgattccataaagaaaatgtggcatatatacaccatggaatactatacagccacaaaaaaatgagaccatgtcctttgcaggaacatggatggagctggaggccattatccttagcaaactaacttaggaacagaaaaccaaataccacatattctcatttataagtgggagctaaatgatgagaacacatggacacatagaggggagcaacacacacttgggcctatcagagggtggggaatgggaggagggagaggatcaggaagaataactaatggatactaggcttaatacctgtgtgacaaaataatctgtacaacaaacccccatgacacaagtttgcctatgtaacagacctgcacatgtacccctgaacttggaagtaaaaagaaaaaagaatgcttaagaaaaagacagtctcaaacaaaagatgaatgaaagacaactcataaaaagagaaatgaaatagatttcacatataaaaagaaattttactaaaaaatttaaaaataaattaacgatattatttccatttaccaaactgacagagattattatgtgtttgccctcttatttctctgactgatgggcatgtaaacttgtataaatgtgacaaagaaaaatacttcacaagagcttttaaaacatgcagaccaggccggacatgacggctcacgcctgtaatcccagcactttgggaggccaaggcgggtggatcacgaggtcaggagatcgagaccatcctggctaacacagtgaaaccccctctctactaaaaatacaaaaaattagccgggcatggtagcgggcacctgtaatcccagctactcaggaggctgaggcaggagaatggcgtgaaccagggaggcggagcttgcagtgagccgagatcgcgccactgcactccagcctgggcgacagagaaagactccgtctcaaaaaaacaaacaaacaaacaaacaaacaaaacaaacaaacaaacaaaaccgtgcagaccatttcactccaaattaatttaaagaaataataaaagaggtttgcaaaagttggggacagagattgccagtatgaggctctcatattggtaaaaagatggaagcaacataaatacctcacaataaaagaataatcaaatgaattttctatagctataatgaagcctgttgaatcttatggccttttcaatgcctatttcaacacatggaaacttgtttatgagatactcataaaaatttttataatgtaattacattatgacataggtgagtagcacaggttgtaaaacagtatgtatgggatataatcctaattttgtatatttatacaagtatgcactgaaaaactggaagtttgtacagtcatccctcattatccatggaggattggttctgggactccctatggatatcaaaatccatggaggctcaagtctcttattaaaatgtagcacttgaatataatctacacatatcctactatgtactttaaatcatctgtagattaaatcatctgtaatacaatgccaatgctacataaacggttgttatactatgttgttaagggaataatgacaagaaaaagtctgtgaatgttcagtacagatgcaactctccattttttaacaacatttaaaaacccacaggtatggaggactgacagcacacagataagtggttatcacgttcttcattctgaatttctccactacatttttttttcacaataagcatgagctgtctctatattcaacaaaaaaaagaataaatgctattgttatggtcatattgtcttcatcaattggcttttcgtgcccctagagttttactcccattgtttctgatgcacagatctggagagaagctcaagagaaggaaggctccctcttcccactctgagctcctacaaccagggctggcccctcacagctgctgccaaagaggatctccagagacccagttggcttttgcttggaggcccccatttatggttgggacgttcccttagttaactgttcccctacattgaggactcacgtttctcattttttttgtttttctctttgctttgttttgaatgatccctttctggattattctgctggttagcaatttcatcactcactccccataccgagttgcctacgcatattgggttaaaccagagaaaagtgttttctatggaagttaaaaaaaaaacgtaaataatagcactttgatctcatttaacctatttctatgatacctaagttatcccatcaaagtggaaaacatttcatttttctgattagaaattctggttaactggttgccccacatgggtagtggtgccaggcagagctacaaggaccctgagcaatactttcacatgagcaggaattggttgatttttacttcagtatttttcgaatattgctttctcactaatctaagctatcaacttggaggatcaggttagagtattgacattgaaataagcttcatatatataaaaaagaacagtttcctcctggattcaatttaaaggaataagcaagaaaagaaaaaaatagataactctcacaaaatttaataaattgattggatttgtgagatatttttaaataaaatttaattcaaaatgttgaaactacagatgactggaaataatgtaaaaatagaaatccaattttaaaatacatatttcatgttggagtagaagaaacgtgcatctcaacttattcctaaagttctcaaagtagaagaataaaataaaatgtaatctagaaataaaagtagaaacctttcagcagctcttgggcaatgattagtaaatgggtcaagtaattactatttaatgtaattgtcattttctttgtaatagtttattgcctttaaccttggtttaagaaatgagattctgttggtatgaaagtaatgatatgagtattcctcaggcaggtagttggatgcacatatctgaaattcaagagagtggatatgggagtcctccattcacagatgatgagtctggatgagaacttagagtgagaagaaccaagtgcaagaattgagttcctgagctcagaattcagggaaaaaagagaaaccagtaatgaattcatgagtgcccaatgagacaagaggaaaactaggagagctcagtgtagggaagccaggagcaggaatatgtctaggaagaggcagaaatcaaccccattaatgctgccaaaaaaggcagctacatagagaattgcccattggatctaactatgccaaggtcactggggaccttaacaagggcagcttttgtggagtcatgaggctgagacaaggtgagacagtagtgagtctgagagaagtggagaatggagaataagcttttttattttttttatttttttaagttttgctgcaaagaataatggtggtggcttgaatcctaacatttcaactcaaaccaagagcaaaatgaggaccacttatctaaatatttaaaatgtaagtgaaactaacaaattgtttcagaaaagatgctctatcttcataccttgggaaaacatacttttgatgtaagatgtttccacaggaagaaagtggcagaaaagtatctgggatctctctgaagattttcttacaactgcgtgtaaatctacaattgtctcaaaatgtacctcaaaaattatcattacaattatctcaaaagttaaaaactgttacctttgttaataacctggaagtacaggcttgagtttagacattagaattcctcagagttctgcttcagaacccggagaaaggactatctgtagaattttcagggcccagtgaaatgaaaatatggggcccctggttcaaaaatgatgaagaatttcaagatgttaacagccagacattaaaccaaatgtggagaccatgtgaacccaagaccccgtctgactgcacaggatgcatggtctccttctagcaggtgtttgcacttgtgtggtttgaacttctccctggcaccatcatcttgcccgcctgtgaggcagaaagagagggaaggtgtaagttgaaagctgtcagaggtcaaacatcaaaaatagagacagattcttgatgacacacttgcatccttcaagtctttgttcataaaccgctgtctcaatgacacctacttgattatctgatttaagatgtcgccccctctcctcacatgcccattactgatctatattttttttccagagcatgtatcaccttctaacaaaatgcatactttattttattgtgattattgttgatctcctctcactactaagttaacaccataaggacagggatttttgtcttttttgtactgaaaaccatgacaagcccatatttagtgcccaataatatagcaaataaatgtatggttggggaaacttagggtccaataaatcagccttaatgtgagggttccctggaaaaaattccccaactacagaatatctgtctcctcttgaatgtgactcccaaatgacacagtggcacactcttgtttcctctttaagatgcaaacattacaaaggcttcacatcattcaactctagggttgagtttgccttttattgcttttggacataagaccacagaccaaagcaagaatagtggagatgtcgcctttaaaatataaaactgaaaacagcaaaagttagagagtgactgagtaggagaataggcaacattttaaagttgattttacaaaggcagtcatcagacagcactgtgtcattttaactcaagattctcaagtggctctcatgctgattgttaaagcaggagaatgattggccctaagatgatgtactcctcccaggaatctgaaattcatagatcatctggaaggaccagagtgcttgtggagtgatgggggatggggtagattattatgagaaagaagagggctcctcaaaggaaaaatgcaaaaaggagactgtaagacagaggcatcaaaagcagatttcatcacttccccagggctcctgagcgcgagagggaattgtctgagtctaattaagaagcatggactttggatcttattgcaggttatggataaaatcagtctcatatcaagtcgtcttgcttctggtgcctgtgtttattaagcttcaggaatagaggaaaagccgaaaggctccttccaggagccctgccttttgtgttatctctgctctttatgatcaacgtgaggaagctctacctacacctccacagcacttaaccgtgtctctttgattagttgggttccaaaccaagattgtgtctcacttttgggccttctcatggctgcctgctggagtaagataatgaagtaaaaagaagttggacaaaagaaaagaaaaaaaataaaaagtttacctgttttagtcctacactttccagtactccatggaaaattccatctcttcatttgatggtctcgattctagaattcaaatgttgccccatcacttttccccagcttgccccccactctggatgtgggatgtggctgaatctcaattattacacaaaatggaaatggaggcacatcagagatttattgtttcaaccttggagactgaaatatattaaaataaatggcaaaaatcatgaatctttgcttgaaaatgcttgtgagttttcaccttgggaattcaaggttacataactagataattacgctttgcataatatgtcaatctttgggcttccgtatcagtcacaacattagcaaaagaagaaaatcttcagcagtctatacccagctgctaccgtggaaacatcccaaagtctaattaagagtttgaaaaaatagttgtaacactccccgaagaactcatctgcattccaacagtattgagaagagtgataatagaattccaccatgtagttaatattagtaagtccaggaaaggattaaagaacaaacattttgaccagagcatagggagatttgacaatttttgcccagaaggactgatgtgacagccgtgtgtggctcctcccattcttcatctgtacaaatggaagagtttattgtgtcactgttcttcaaagataactttcattattgttgtttgcttttgttgttgctgttcataagtcttcagatcaagaagtgtcagatggagagactacagaaaacactgacctttgattgacagtgattaggcggtgttttcttccactagagcatgagatacgtcacacagagggagagaaatgaagatgtatggccaagagggtgcactgggataacttgttttgtcaactcttggctctctcttcctggaagaagattctccctccccttcttcacatggtcagactggacaaggagacttgctttggctagcagtgtgagctgacaaggtatgtacactgcatctgagcagatgctttaagaacgttggtgtgggccgggcgcggtggcttatgcctgtaattccgacatttagggaggctgaggcgggcggatcacgaggtcaggagataaagaccatcctggccaatatggtgaaaacctgtctctactaaatgtacaaaaattagctgggtgtggctgcatgcctgtagttccagctactccagaggctgaggctccagtgagcccagatcatgccactgccctccagcctgggctacagagtgagactccatctaaaaaaaaaaaaactttggtatgtttgtctcacctctgaggctccttgcctttggccatgatcaggacatgtctcaagtaggggctgctccttcagcttttatcctgaataaagtttcatgaagccaacccacagggaatgtaaaatgtgaatgagaaataaaccagagatttgagggttgagggttgtttggaactgtagcaaaataaatatagtgaaaactgacagattctggaattacctatatagttgagtacctgcacaacaagagtaaagcaatgttgtgcctagaaagcatcaggtcaatatggccaaaggtttctttgtcaaagtttaaaagatctgagaaggccaggtgatgtggctcatgcctgtcatcccagcactttgagagaccaaagtgggaggatcacttgaggccaagagtttgagactagcttgggtaacataatgagaccccatctctacaaaaattaaaaatcagctggtcatggttgtgcacaactgtagtcctagctactggagaggctgaggctggaggatcacatgaggccaggagtttgaggttacagtgagctatgattgcacaccacaccccagccacagcaacctagtgagaccctgtctcaaaaaaaaaaagaaaaagaagtttgaaaaacaaagggttggcagcatataaacaaaacatctagactctcttgggtagtctagactgaaacgtagactgaaatgatgatgtggcctgccctactgtttggctgtaatcaccgtgccaaaagaatttgtagtgcttttgaatttaggaaaattctggcaagtaggacttacttgcattctatgtaactatactgtgtgctgaatatgattttctcagggagtaatcaaaacagatttctttgaagatgaagcaaagttcagaggttttgttacctgaatatctgtacatttagaatgggatgtctagccgtaactgattcgaaggttatttgatttctctcctgctttatgtaagttagttttagaggggggtagacagattgctattctctgttccattcctcttgttatccccaaacaaaaatattaaggcctcaacattcctttttaaaaaatcaacattaaagctcacacattcaaagtcatttgtataaattacatggaaagctgttgccctcccacaatcggtgggctctaaacagaagtctgacacagcttgtcagtgttcttgttggggcatcaataaccttggcctttgggaaggagagatggatgaagacggatgggtggtggactccgccagtcaggtctctccactgccaatcatggacaccagcacattcactagaggcagagctactcaaatgcaattaccagatgccgccgccagaacaactgttcctcatctcactcagagccattgctctggcttttctgctacctcttaatcattttaataatgtgacgtgctgctttttctttgtttggtgtatgctgcagtgacaatattttccaaagaatgattcataatgtgttagaattcatagtttacatgtgcctgtcaaccatttgtaatgcaggtgtttagaaagttagcatatttgagtagagccctgatagtgaaagaggcatgtttgaatgtacgtaaagtcaataggaaaaatttaggcacacatatgccttagctttctttaaatataaatactttatatttccttaaataaaatataaacctaccatacattaatttatttgagtggtttctgctctctgtatattttcaacttatacttctgctttattaggacaatgctagctgctgtaacaaataagtccaacactttggttgtttaatataatgcagtttttgttgttgttgttcatggatcatgtaagagtccagtgagaaattcctggaaagtagtcagttttcctttaactcgtgactcagagatcctaaagccttccatcttgtggctccactatgccctgggtgctatagtagaccctcaaagtcttcttcctctaaccagcagaaggacaaaaagacagcaaaaaaaaaaaaaaaaaaaaaaaaaaaaaaaaaaaaagcatatctgcttcttaaataccccagctcagaagtgacacacatatcactcccactcatatcacattgaagataattggatatggccagacttaaatgtaaagttgaggtggaaaatgttgtcctaagttgggaaaccacctaccaaaaccatctctatattatggaagaaagagtaccattttttgttggatagttctctgtctgtgccacaaacaccttgtgcgataataagtttttgctcgtatattttaaaacacaggacttctttttatgtcaatgttatgtcaattctatttcaaaattcaaggggtaacttttacatacatcactggatgactaacattctgcttccatctttctgtacaaacaatttgtattctagttctcaaagcattgttatgtaatgcttgctgattcatattcacttaaacagggttcatatggagagtttcacacccatgatttggggttgaggacaaacataacaacatgtacctcacacactcttcgcttacataccataaaaccattaatactatgaccccagagacttactccccagaaagaatccaagtaatttctaattctcccccattattcatttactcattcagaaatactcattaatttcctgctagatgccaggcatgaagtctcattttacattcttcagccagtgtaaaatattccatgtaactacctataatttttaatgtcaattcattaagaactttccaaagggaaatgcatcatattacctgattctgcacctcttccctgtaacatgtccacctgcttattctttttctcaaaatgctctggcttcttactgctcagccgggaagccattctcccacagtgcttatgtactaaagtgtaaacgctgagctgcttttactggcgtggagcagtggctcacagtttcggagaccatactcttcacctcccttccccaactccttcttgtgccttccactcacctggggaatccatcagccctttagctctttagcggaaaaagccactttgctgaacaaaagtctgtctctcaccactccttgatcatcccatgaggtcccatcccagaaagtctcactttgaggaacaaggaaagaagtccatactaaggacttggtaataaagttagattggttttcaactttgttttgttctattttattttcaaccaaaatgaaggagaactcaattgaattgtcagctgatagatcgttaaaagcaatttttgatgataaaatgtagtatgatttctggagtatagtttggaaagtattcaaagaattgagtggcattgttataacaatctgactctatttccatctatttatgtggatgaattttctaagtagttgaacttataaaactgagaaataggaatagaattgatgttaaatcttttttcactttagcaataagtaatatttatatggggacatatgaactaaaagaaaaaagaataaaaaggaaaaggaagaaaatagaagaaaaaatccctcttgctaaggatgcatttttcaataaaatgttatgttctttcatataattataaaaatttgtgagacatttttatttttgttttattgtaccatggtaattattgcaatgataactaaatccacaattattcaaaatatagaccagagtatttaaaatatcacatattttagaaaattaaatatgaatacatactcatatttatattgtagagaagtataatggaaatgcagatttaatgactgaaacaaattttgtgaaacttctcctatgaaagaagagtttgttcaggtagtttaaaaatagtgaatagtagatatcaaattactttggaatttagattttattggatatatttacagaagaaaatataaaggttttacttaaaatttccagtgtttgtaagacattaaaacttaaagacttacatgttagaactaaaaccataaaaaccctagaagaaaacctaggcaataccattcaggacataggcatgggcaagagcttcatgtctaaaacaccaaaagcaatggcaacaaaagctaaaattgacaaatggaatctaattaaactcaagagcttctgcacagcaaaagaaactaccatcagagtgaacaggcaacctacagaatgggagaaaatttttgcaacctactcatctgacaaagggctaatatccagaatctacaatgaacttaaacaaatttacaagaaaaaaacaaccccatcaaaaagtgcgcgaagtatatgaacagacacttctcaaaagaagacatttatgcagccaaaaaacacatgaaaaaatgctcatcatcactggctatcagagaaatgcaaatcaaaaccacaatgagataccatctcacaccagttagaatggcaatcattaaaaagtcaggaaacaacagatgctggaaaggatgtggagaaataggaacacttttacactgttggtgggagtgtaaactagttcaaccattgtggaagtcggtgtggtgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaacgatgagttcatgtcctttgtagggacgtggatgaagctggaaaccatcattctcagcaaactatcgcaaggacaaaaaaccaaacactgcatgttctcactcataggtgggaactgaacaatgagaacacatggacacaggaaggggaacatcacacaccggggactgttgtggggtggggggaagggggagggatagcattaggagatatacctaatgctaaatgacgagttaatgggtgcagcacaccaacatggcacgtgtatacatatataacaaacctgcatgttgtgcatatttaccctaagacttaaagtataataataataaaattttttaaaaaagttaatctggcacagattgtctgaaccacaaaaaaaaatttatatccttgtaattatttaaatttatgataaaacattttggatattaacctaaaatgtgagaagggatatatagtttttcaacatccttttgggaaaagtatttgaatatttctatcatggtgttagtgtacatccacatttgcatgcaccagattgaactagaagcagacagtatgctcacatccaggtcttctccctcttacctgaacaccttggggttggagacatatctaacttcacaaaggtaatatgatgcctataccatacagtacgtaaagacctgtggtgggttaaaatgatcacaaatcctttgctacttctctttttgagagatggggtctattctccttgtcctgaagtctgggctggactgtgacttggccactaaaaggcagtgtaagtgacatggtaacctttgagtctgggccttaggaaagctgcagctttacttcaatcttcttggagttcaacctcttaaaatccaaaagccttgctgaagaagtccaaatgagttgcacggagaaggctcatggaaaataactgacatagccaaaggcccagctcagccctacctgacagccagcaccaactgccagccatgtgagtgagctgagccacctctggcatccccagctcaagggaacctccagctgactgcaacccccagctgatactaggaggaacagaagaaccacccagctaagcccatcaacccttagaatcatgagataataaatggctgctgttagtttaagctgtatgatttggtgtagctcattacatagcaatagataattggcattttccaccaatggagtctaggacagcattatgaatttgaatctgaaccttagagcccagatgaaatctgttctccagaatggagtcactaataacacccatcagaggttccctgtaaccttataaccatcactgcacactcagaggcacctttcattggctttttgtatcttttcttgttgccacattagctcataagctccctgaaggcagggaaatattcttcttctctatctgtctggaagtcccaacctttgggctttgcacccaaacacacccacaaggtgaaaacttgccatcctcaagtattcttctatctcatcttagtgtattatatatgtctacaattacccctcttttgtagatatggaaactgatgcccagagatgtcaagatgtttctcaaagtcacacagctaataaatggaaatgcttggatttgaacatgggtaggtgagctttggagcactacaaatgctgtctatattttgaataaccatcagctgagctgcctaattcagccagtaagcatttcttaggtgacaggaggttatatatgaactggtacctttcttcctacaaaatttgatacatttagcaaatgtttagagaccagcaaaatactgtattagttacccaaagtgatacaaagatgattgactattcatggaaatcactcagaagtcaaatatacaggtataaaaatgtatactgctcacacaatttgcatttgcaaaaatgtgaaaccagtccaaatgcccatcaatcaacaagtggttaaagaaactgtggtgtgtatataatacacacacacacacacacacacacacacacacacacacacacaatgggctacttctcagccataaaaaggaatgaattaatggcattcacagcaacctgaatgggattggagactattattctaagtgaagtaactcaggaatggaaaaccaaacatcgtgtgttctcactcataagtggaagctaagctgtgatgatgcaaaggcataagtaggatacaatggactttgcagactcaggggaaagggtgagaagtgggtgagacataaaagactacaaattgagttcagtgtatacagctcaggtgatgggtgcacccaaaatctcacaaatcaacgctaaggaacttattcatataaccaaataccacctgttccccaaaaacctatggaaataaaaatttttttaaaaaaacaattattgcaataaaacaagtcacatatacacacacatagtaagtatatatatatatatatatacactgtgtatatatatctacacacatatatatacagtatatatatatacactgtatatatatatctacacatatatatacagtgtatatatatacatataatagtgaattaataaactactagttcgatctccctggctcatttgtcaaggagcttacaatctctcttattaagaaaacacatattcattaaagcaggtgctcttataaaaagaggtacagccaaataagaccacaaggtaaaagaaatacaagctttaataacaatctaattatgcccaaatgatgcttaccagatacaagctttacttaaatctttttccccccttttcacttaaccgttgtggacaccttagaccttctcaacagtcccctttcttccagggccaagtccttcccaactccaagcccctcacaattctagggttcctccctgccccccttcattcttcctgctattcatgtgtttgcttcaccaaaagtcttcatcctgcactggtcattggccctgtgtcctcctcttctttgaaatgtactgattttaaaacttcccctcttggtgagaagttttctattttatagccctgccttttccagaaaccagatgccttttctcctgaatatttggaagtctgcaaaagcaaccaaattcatttaaagtgacacctgagaggatgaattcctgaaaggtgcatttaatcaaggttaaccagtttgccatggcctgaaattacgacatgtcatgttagaaagatgtacaatttggcaacattttcaaagtctgtaggttttgaacctacagtaaaccattgacctccctattttaggggcaaacacttttgaagagaatctgcattccacttgctaaaccatataaaacaaggtggaagagaaaaaagattcaattaaacatcacttggggatttcaaagaaaagatattaatctgtcttctcataaaactcttcacccacaattgtgatgaatttgaatgattagtaataatctctcagacttaaaaaaaacagacagctggatcattgaatttgaaaaataatcctttgctatttacatagaaatcgttagaggctgagtttttaggtttatagttttacagtaataaaattattttttttaaattagccaggtgtgatagttgtgcacatttagtcccagctactcaggagactgaggcaggaagattgcttgagcccaagagttcaaggttgcagtaagctatgattgtatcacccagcctggagaacagagtaagactctgtctctaaaagtaataaaataaggctgggtgtggtggctcacacctgtaatcccagcactttgggaggctgaggtgggtggatcatgaggtcaagagatcgagaccatcctggccaacatggtgaaaccccatctctactaaaaatacaaaaattagccaggtgcggtggtgggtgcctgtagtcccagctactcgggaggctgaggcaggagaatcgcttgaacctgggaggcggaggttgcagtgagccaagattgtaccactgcactccagcctggcgacagagtgagaatccgtctcaaataataataataataataaaataaaataaatataaatataaacaaggttaatatttgtatttataacatagaattatatataaatacccagtttgccatttaaatagttaacatctagggcattgtagaatatgcatatttaggttcatacagaggctatgtatttaggtagtattgttgacaaaatatcaacaatattgccctaaaagactgcttctgaaattagaaaagcttcacattttaaaagaaatgcaaatatttgtctatttgctgctcactttcgctgtatcacaaaacacctgaagggctacttgccttcggattttcttatcttaatggtaaacagtgttgacgatgaaaatcacacagcactttgctgcaaatctgagtttttatgtgtagtggataaatggcacatccgtgcccagtgctatgaattgctcctctgaaatcatgactcaaagagggcctggaaagatgaataactgtccactcctggacaatcatctccaccgctgctctgaggtcaggtaacagcagggggcttatgtcttctcacttgcttagggacatgaagtccatccctgcaacatagtctccctgacaaagcttcccaggaaattaaggtctctttgtaacttgttatctattagaggtaactgtctgcatttctgaaaactgatcagctcctaaaggcctaagagcgtagccacttgccctttgctcttggcccccactgacactattctgaggatataggctcaacttaagtggaccttgataaggcaagcatgaattgctgcaggcttgtgcacacaggatgtggcccactcacattaggtggcccattctgtggttgttctaaactcaaggtcagtaatgatcataaataaattgcaccaaagtgccggaggatgaaggacaagattgcttcacaggctggagattagagctattgtagcttgatgaagtagccagtggtccccacacttcctggacagctagcttattaggaataagtctttgtcatcaaattgcagagaagactgcaaactcctcttactggttttatgagtaactgtacccgagggaggcttgcatgactgtctggtaaactccaggctgggaaccatttgtgaatatggttgcagaggatttcagtgtgaataagaccaggtgcctgaaaagctagattttaatagaatgatacaatcaataatattaccatttaacatgttgtatcagttagaattgggcagttgcatggaagagaaggcccaaacagtgctttatccaaaatagaaatatatttgttgcacctgtaaaagcagagtcccaagaaaggcatcaagggagtgtgtggacctgctttcctaagtctgcaggacacaggatctgtccagctcataccgcttctgttcccagaatgtgtctcgtgacctcagtgtccaggcaggatgtcagagctccagccatcgcagccatggtccagggaggaagaaggtggccctcttccattcagagacactttctgggaattgcatgaagcacttgtacttacatttcatgggccgaaacacatggtcacatctgggttcaagagacatacgcaagcagtcatttggtttgatgccaaagagactagaaaaaaagaactggggtcttattactaagaaaaagtaggaaagtgtatattgggaggcgggggcaagtaggagcttctgctacatataattataacctcttaccgtgtaaatgactttccattaggggctactttttaaaaacaaaattttctcttttaaagctgtcatattatttaaacctagaaacaaaataaatgaacaatgcttgcctgctcatgatgatgatgtagagaattatattctggctagaaattatttgaaatccaataaactgtactaattatatattaactcatcaagttcctaaagaactttgatattgtaaagtaccacagaattaaaatataattctcactaagctagattgagatttttttattgaaatttactttgctaaaaataaaataacagcaaaaagtctataagagaagattgtactcatcagtccagaagttctaaaactaaaatccctaaagctttttaaagtattaggattctagtcatagaattaaaccatttattctcttgaaaaaagggttacaatgacctctccagtgtcctcccctcaagacacacacacacattaaaatttatattttgaattctaaatctggttgctacgacaactacaaaaacgacactcactttcattggggcatgctggttccatttgtttttaaagaaaagggtgtattttgctccctgtgagacagaaatgatggatggagtctgagcctagaggtcagaagactggtttctattctcagcttccagcattgatttgtgtggctgcaggctagttacttaaagtctttggttttacatccactatgtacaaaacttattttcctttgatatgtacccttcataagtggtaggtgttaactggggaatttaccatgaaaacccttgagattctcccattctggtactgcccaacctaatttccctaaacaggtaactttttttcttttttctttttagtttaattttatttattttattttattattattataagttttagggtacatgtgcacaatgtgcaggttagttacatatgtatacatgtgccatgctggtgcgctgcacccactaactcgtcatctagcattaggtatatctcccaatgctatccctcccccctccccccacctcacaacagtccccagagtgtgatgttccccttcctgtgtccatgtgttctcattgttcaattcccacctatgagtgagaataagcggtgtttggttttttgttcttacgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctttccagcacctgttgtttcctgaatttaatgattgccattctaactggtgtgagatggtatctcattgtggttttgatttgcatttctctgatggccagtgatggtgagcactttttcatgtgttttttggctgcataaatgtcttcttttgagaagcatctgttcatgtccttcgcccactttttgatggggttgtttgttttttcttgtaaatttgtttaagttcattgtagattctggatattagccctttgtcagatgagtaggttgcgaaaattttctcccattttgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagtaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcttacctgattgccctggccagaacttccaacactatgttgaatgggagtggtgagagagggcatccctgtcttgtgccagttttcaaagggaatgcttccagtttttgcccattccgtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgctggattacatttattgatttgcgtatattgaaccagccttgtatcccagggatgaagcccacttgatcatgatggataagctttttgatgtgctgctggattcggtttgccagtattttattgaggatttttgcatcaatgttcatcaaggatattggtctaaaattctcttttttggttgtgtctttgcccggctttggtatcaggatgatgctggcctcataaaatgagttagggaggattccctctttttctattgattggaatagtttcagaaggaatggtaccagttcctccttgtacctctggtagaattcggctgtcaatccatctggtcctggactctttttggttggtaagctattgattattgccacaatttcagatcctgttgttggtctattcagagattcaacttcttcctggtttagtcttgggagagtgtatgtgtcaaggaatttatccatttcttctagattttctagtttatttgcgtagaggtgtttgtagtattctctgatgatagtttgtatttctgtgggatccgtggtgatatcccctttatcattttttattgcgtctatttgattcttctctctttttttctttattagtcttgctagcggtctatcaattttgttgatcctttcaaaaaaccagctcctgggttcattaattttttgaagggttttttgtgtctctttttccttcagttctgctctgattttagttatttcttgccttctgctagcttttgaatgcctacacaggtaattcttctgcattacacaatcaagtgtactctgtgtagccactaaacttcaagaaattgtttggattcagatgtacttaaatgataagaaacccatttataacccattcacaggcagggcctggggaggcaggtttctctaaacactttgcataaaattagacaagaccaagagagtttagacaaagctcaggctggttccatttcaaatctcagatccagtggacatgtgaatgaatacctgggattatgtgtttctggcatagaccaggcaatttcacctgccacacaactgtgcctaatgaatgctttcttctcactccgaatggatcttctgccacatctaaacacatggtatgattgtcagttgttctgttaccataaagttctgagacaaaacttcccatgtcaaaataaatcagtctgctaagaattttttggttcatctggaaaccttgggactgcctatatttccaggactatttaaaaatattttaaaaggtctgccaaaaaatgggaatatatgaagaatcagcatgataactagtttgaacacattttttatgaagcaaaccacagaatgcttcacagagttaataaaaacatgagtcctcagaactctttatgacatttgagactaaaattggcttcactttaaatcacagactttagagtcaggcagacctaggtataaatcttctatttaccttttacttgttgtgagatttttggcaaatgacttaacctctctgagcctcagctttctcatctgtgaaacggaaatgtctgcttcccagggttatgggggttaaagaatgaaactgtgaagaatgcaactagacttcaacatcagtcactcccaaggttctttcctttctgtttagaagtcacctctgtggaaaaagaaggcagatcctacacaggtgatgggattttatgctcaacctggacaactttcaatccttccttcttatttgtgtgcaagtaataaaattaaaaaagcttgagttccataatcaacacaaaacctcataaagcccagaccaagccattttctttcattctttgcgttctttctttctgctcatttgggaacatctttatcttgtagacacttcaagaaaatgacaggcaaccatggctagtgtggggacacaggactctgtaaagcgggagaaaagattccaagggtgccgttagcctagttctttctgccccttcagtaaaacagtgtcaacaacccttgcattcctgcagcttcaggacagcatcccgtgctcagaaggttccctggacttcccgtcctcccaagcaagttgaaacttttgtctttgttcatcagtgttagtgagtatagtctaaggaaggtagcacattagctgcctttgctttctttctccatcccttggtatcctgaggcgcataaggatttaagagttgctgggcacggtggttcaggcctgtaatctcagcactttgggaggctgaggcgggtggatcacctgaggtcaggagttggagaccagcctggccaatatggcaaaaccctgtctctaccaaaaatacaaaagttagctgggtgtggtggcgagaggctgtaatcccagctactcaggaggctgaggcaggagaatcacttgaacccagaaggtggaggttgcagtgagccaacatcgcaccactaaacttccagcctggtgacaagagcaagactccatctccaagggggaaaaaaagtcaactaacacagttctgggagctccatgacactgagtttaagcaaagtagaggagcccattgtagcctactctgaggacagcgttttatttccaaatattgttcttcctagatctagaagccaaactttctatattttaagctacatgtcacactcctcttctacaactaacattaattttgctgaggaaaaaatacaaatgcatggtactgtcataataaagccgctgccaggggaagagaacacagctgatctcctcctgccccctcacccttctgctcagcgcagctcagagcaatgcacacgtgtcagaggccacagagaaacctgcggccttcttttgtcaacatttcttttagaacattggcaaagatctcaaatgtcagtgtgtagaggtatgacagataaagatttgtaagtgcgtgtgtgacagagaaagaatatgtatgctcaatgaagaagctgttgtacacatggctttggagtctgtgtgaggacaccctcaaccctccaggtcagcctctggtcctcccatatgaatgctatcccttgattcccaccagggtcatccaacactggcctcaagccaactcctcctaggagccttttcgactctcatgctcatcaaacagctgctctctgaacacattctaaagctcccctgcagactggccacccacatctctctcttcacctccacatgaggaatagcagtttaatcatgcataagttaatatttctctgaatctgtgcttaactcccttagactccaggatgctgtggagtgtctgtcagtgcaaagggcatcatcaccatcactctttcctggctggaggtggagtaggggtggggtaaaatatgtagggctcctgtagccagggagaagcctgatgagttgtcattcctcctgataggggcacatagatcaaatctatgatggtaatagaagggaataagacacctaagctcataaagagaaagcagtcccaccaatcttgtaattaaagaatagcaaactaatacaacagtacgtgcatctctcacacttactacctgggtggcttgaaggaacctgggaaccctctagagcctcgtttgtcaacatgggaaataaagaacataaaaccaagcatatagacctgtccagagaattgttaatgtaaaacctggcatatcatggaggaaatggtggttgtaatgtccctggtcgtgggtacatcaatcatctgctgctattcttttttttttgagacagggtctcactctgtcacccaggctggagtgcagcagcaggatcacggctcactgcaacctctacttcctaggctcaagctatcctccttcctcagcctcctgagtatctaggactacaggtgcatgccagcacacctggctatttttttttttttttttgagatggagtttcgctctgtcacccaggctggagtgcagtggtgtgatctcggatcactacagcctctgcctcctgggttcaagcaattctcctgctcagcctcccgagtagctgggactacaggcacgtgctgccacgccctactaatttttgtatttttagtagagatggggtttcaccctgttggccaggatggtcttgatctcctgaactcatgatccacccacctcagcctccccaagtgctgggattacaggtgtgagccaccgcacctggcctgtattttttgtaagatagggtttggccatgttgcccaggctgatttcaaactccagggctctagtgatctgcccacctctgcctcccaaagtgtgaggattacaggtgtaagccaccacacctgctttgcaattttttaaaaattaataaaactgaaagttggccaaatttagggcaaacaagtaaaataataattatgtacactattatagaatgtgtaatcttttaagggcattgggtcatacatgctcagaattccccaaatatgatccatatcacttgtttcattgattatattctggtgaatttgtgataagaaaacaattttaaaatgccccatgtgtcatgattataaaactataataattaagacagtacctggttatatgactaagatcaatgtgtaagaatgggaagtctagtcacaaggcccacatatttgcagttacctgaaaaagtggcagtgccacgcagaagagatggttgttttggttgatgctaagccaggtgctaggccaactggatatccatgagaaaaaatgattctgaccccaacttcacactaaacacaaaaatcaatgacagatggagtgcagatctaaaatgcaaatggcagaacaataaatcttttagaagaaaatataagaaaacatattcgtgaccatggagtaggcacagatttcttaaacaagatccataagatgttaattataaaggaaaaaatgataaattagaaccacattaaaatcaagaacttctatatatcaagacatcattcggattgagaagaaaactcactgaatgagacaaatttttgaaaaatatgtatctgaaaaaaaaaaaaaacttgtatccagaatatataaagaactacaaatcatcaagaaaaagggaagactgcccactgggcaaatggcaaaagactggagcaggcacttcatgaaaaagggcactccaaagaaaaaatagacatatgaaaatatgcccaacaaggctggggagaaataggaacacttttacactgttggtgggagtgtaaattagttcagcccttgtggaagagagtgtggcgattcctgaaggatctagaaccagaaataccatttgacccagcaatcccattactgggtatacacccaaaggatcataaatcattctacgataaagacacaagcccatgtatatttattggagcactattaacgatagtaaagacttggagccaacccatatgcccatcaatgatagactggataaagaaaacgtggcacatatacaccttggaatactatgtaaccataaaaaagaatgaactcatgtcctttgctgggacatggatgaagctgtaagccatcatcctcagcaaactaacacaggagcagaaaaccaaacacagcatgttctcacttaaaagtgagatttgaacaatgagaacaaatggacacagggaggagaacatcacacaccggggcctgtcggcaggtgggaggcaaggggagggagagcattaggacaaatacctaatgcatgcagggcttaaaacctagctgttggattgataggtgcagcaaaccaccacggcacatgtatacctatgtaacaaacctgcacgttctgcacatgtatcccagaacttaaagtgaagaaagaaatacgcccacgaggcaacagacaaatgtgattaagaccacaggaaggtatcaccacacagtcattaggatggctaaagtgccaacgatgaaaagtatggacgtggaaccaatgaaaccttcttacactgctgaacacaccatatggctgtggcccagggtttagagccaacagaatcaaacaagtatgttcacaaaagacatgcgtaaaaatgttcatagtggcactgtttgtatagacccaaactggaaactacttaaaagcccatccgcagcagaatggataaaaaaattgcagtgtatattcacacatcgaatgctatgcagctgtgataacgaatgagctacaactacatgcaacacagatgaatgccacacacaacagtgaggaaaggaaaccagacatagcaggcagaggtcatctgctttagaagtcagtagttactgtcaagcaggggaaaggagatgtcaggggatcctctggtgctggtaatgctgtgtttcttctggttgcaaggtgtgttcagtttgtgaaaactccttgagccatatccttatgatttgtagcatttgtgaatccttatggtttgtatgcatttctgggtgtattctatgcctcaataaaaagtttaccctccaaagtacaatacatatgaagacacacacacacagacacacgtaaagctcactaacaccagattggagaagcagtttcaatgtctcagtcctaccctataactcctgtagaccttctagctgctaacgcacagaatacttcattttcgacacattctgccccagtttatcttgcatctgaatttccttattgtattatcaaataagagatatatatatcaaaccttattagtgtttgtttcccataaaatccactgctccatttccaggtctgggcttaagacgctgatcggtgggattgccagctgagcagatctcagacactccagctcctcttttggttgaatcagtgggtcactaatagttattgacaccaactgagctcaatatcactggtcatcattaccagtccacggaatccacagagacagtcatccacatttcccgttgtgattggtgaggcattagaaaggatagattttcacagggcgaggttgtgaaaatgacttgaaaaatctcagtggctaacaggtaaaggcatgtcttcctcgcaccacaggttctgctcatcttcacgatccaagaactcaggtgacccaggtctccctgtttccatcatcaagatgggaaaggagcaggtgctggttcttaaagcttctatccagaacactcatatctcattgacaaagacaagcccgagattctcctcaaggatgtgccatcctccatgaaaggggcgctgaatactgtggattctggtgcctcccaccgtgggggcagctagggggtatcagcaacaccggatgctgacaaaatcacattgattttcttcccaggtgtggtttggagagaggagcactttgggtaatgagggaaaggaggcacagccagccagccagttagcaggatcaaccctggtcctcagtgggtgatattccatccagtcaattatatatatatatataatatatactcttattaagtatatattatatattaagtgtatatatatatatatatactcttattaaggaacaaaagttgggccaggcatggctcatgcctgtaatcccaacactttgagaagttaaggcaggaggccttaggagttgaacttgagcccaggagttcgagaccagtctgggcaacaaagagagaccctatctcaaaaaaaaaaataaaaatgataaaaccagctggccatgatggcacacaattgtagtcctagctactcagaggctgaggtgggtgcatcgcttggacctgagagttcgaggctgcagtgagccatgattacacttacacttactgcactccagcctgggtgacaaagcaaaaccctgtctcaaaaacatatttaaaaagaagaaaagttatttaatgatatttgctatcactgctaaaacctggtaagaaagactttcttcaggatcatctcgacaggcatagggactactgcaatgggattttgcagtgtgggagagagattgggctgaactctgaatacaacctggacaagtgggaatttctagcccaggagcatggtgggggtcagttgatggaaaattacaaggaataaacatcaaggataaggggaattctggctaagctgacctaacgggtttcttactgaagacaggccagggtgatcagactatatctgtggaatggtggaggtggaagatcttgatcaaatatagacgagataatgagggtggggagttcttgctaaactgacttggccgggatcttgctaaactgaactttacaaggaagtgcacagatgggcccaggagaaggttcaggagcctgactaaagtttaatcaaaaaagaatctttgtcattctgcaagctcagagggactcttgggtgatcaataataatttagctccattttcttttgtttgtccaatgttgtactttaaagaacacctaaagaaaaaataaaatacaatcaaaatttggagaaataatttctccatgaagatgtgaagggctctgtatttatttaacttaaagacaaggaacagagtcaacagccattaagtaagtgacttgataatacataaacacatttcctcattcctcttagagatgagacaaaaagaaattatttatttaacagcagagccatcttaggctaaacactaggaagagctgactttgcattttattgtctgaggagattgtgaggtcttaacatgcccctgaatgtagtatcactgaattaatttggggattccctccccccatcaaatttggaaacatttattgaggctttgctcattatttagtaaagttaacctcctctttataagagaagtgtactgaacatatgcataatatttgcagttctataaagtttaaaataaaaaagaagtttatatcacaggtggcaggggctcaatataagttgttaattttattgagtgaattattttaccataaaagtatgtttcagcattttctagaaacccttattttgtctgagaatctgatagagctgctctcaatacttacatggctcagctggcaaagggaggacaaaatgattgtaaatagctttgcttttcctcactgaaagcctttttaggttttgaagcctctaatgaagggagaagacactggctccacactccaggtacagagctgtttttgataagatgaaaaggatgtttttcttaccaggtatcattctcttcagaagtaatgtttcctacacaaagtgactgcatgtcaaatgtgcaatttgtctctccagagcacagtgactggcttcttcgttcctgatataatggctagctctggatttttcttggtaatttctatatctctgttttcctctcaattgtaatattcctgcatcagaagacgaactcagaagttgtggttctgcgaaaaaaattagtttctactgtgaattttcttttcttatcaaattgtactaaaataactgttcacaacagtgtttcaccaaatcgttctcaaatttggtgaaatttcatttaattcttcccattgatttaaaacataaggtatattggatgcctaattattgctgcaattatgttctgaaatacataacataatattgaccaactatattttctatggtggtaaaacatagataatgcacactgaccattttaatcctttcaaggtgtactatcaagctgtggttttctttgacagatgacaccatcctacagcgggagaccttctccccggttcacaccaggactccagaaaggacaccccagcgtatcctactgtggagcacataactggatgctaaagaagaggtctgcattaactgactgcccagcagctccttccccagctgagctcattgccatctaatccattgcaaatatacaggagcgtgccttggctgtctctttcggagtggagaagcttgacatttggatacgattggttgcagaagttaagaactaagtttcacttctttatttaacctgaaagttctcttaattccctgcatcattgtgccaataattctgctttctgagactttgctggatgaagaagacatctggatttgattttagagaaagaaaaagccaagacaatgaaataagtgtgtttgtaaatgtaacttttaggtccgttacatggttttgtcctgtttcttcccacccccactcccaattccccttcctgttaaaacctcaagtcaaatcacaaacctatctggctgctttcaaatgtaaaagaagactttacaccaaaaatacagacttctctaatggtctaaactacaacttcaaaacttaaattgttcctatggatgcaaatgcttaagaaattggtcgtaaaataatctctctttaaaatataaaccttagcattttataatgacaacaaaccatgtttctcattggcaaaagcactgctgtttctaagtctctcgtctcacaagaatgagagcctcactggtctccccccagcacctagagcaggacctggcaaagagctggccctccttcaatatctgcataatgaataactctccatggaaaccagtgccactgtggtcagtgacaacgtgctgtaacttactccgaagacagcaggggcatgggtgacaccgggagctcaggccatttgcaccaggctctctctgggtctttgtttatgccccttccccttcctcctcctctgtcactggcctctccatatgaagtctctccttttctttccctcctcaccatggcctttgtgccttttcttctccttccctttaattcccactttcttcctttgagctttctcttcccttcctctcattttccattgttctcctcccctttccaccttctcctttatgtagtaaaaacatggatctgacgtgtattttaaattggcattttaatatcctatcagcttccattcttcatttttctcatggagcatacaaattgtataagtgtttacctggcaacaactatgttttgcttgtttgtggcaaaaaaaaaaaaattgccacgatgacaagtgcctcttgccaagtcgggtgtgcaggtgcagagtcacacccagccgccctcaaggtccacacgttgcccagtcatctggcggttttctctctaacccaagcatcctggtgcctgcgatgaggggaataggtaaccctattgctacactcccagcttatgaagaacacagaacacagagctcaagggaaaagagaattcttttggagacaaaagataattttgtacttctaatctggatccctaaggtcgtgccctacctcccctatgaccatccccatctttactgaagtataattgactaatacaaattgtatatagttacggtggacaatgtgatgttttgatatgtgagtacattgtggtatgatcactataatcaagctaatcagcatatccatcacctcacatagttgccttttgttttttgcctgtgtatggtgaaaaaatttaagatctactctgttagcacttttcaagcatacaatgcagagttgtgcccttagttaaaggactcgggggctttgtgaggtctgaatcctattgattatccagtgcctgctttttcccccttccagtttttctgttcagttaatgttggtgccacatacattaaattgagtatgtggacagcagagtgcagttcctgaataaagagaatatgaaaatctattacttattgcttaagttaacaggaataagtgttaggcttatttctgattctataggacaatcaatacctgtttttatcaagtacctgcctccttaattaagagcaatagctgacaaaagttaattagcaatgtcaacatgaccctatcacgttgccctgctctgacttcaaagaaaatttagataatgttaaaggattagaaaagaataacagaaagtccagcatgcctactttaaaacacctgagttttcaagttctccagatataagttatatataactttttattatataacatattatataatctgagggaaaaaaaatgccacgatgacaagtgcctcttgccaagtcgggtgtgcaggtgcagagtcacacccagccgccctcaaggtccacacgttgcccagtcatctggcggttttctctctaacccaagtatcctggtgcctgtgatgaagggaataagtaaccctattcactcccagcttatgaagaacacagaacacagagctcaagggaaaagagaattcttttggagacaaaagataattttgtacttctaatctggatccctaaggtcgttccctaccccccccatgaccatcccccatctttactgcagtataactgactaatacaaattgtatatacagtggacaatgtgatgtccctctttcttcctgctaatatcacatacatttgtactgtttcttttgaaaacttgtagaaaacttggaggggaaagcatttctagcctctcctgttggtcagtggattaatttgcctccagtaagtgtctctgtggcttactgtcattcagctgataccgaagctttcccttcctggatgctcaggacatgtgatttgaggataagtttacctgggcttttcaggcatctttgtttgcttcttttcattccaaagcttttgctaggaacagggaagctgacacatcagcaggcgaggacccttcaatagtgtggagagtgagggaaggttgaacagctagagaacacaaagggaagaaaataatatactttgccatttctataaccttaatacaattttaataaaatttttctttggaggctttaaattcatttctttaagaagctttgttgagcaaaaatattcttacaattgccattaagtgcaccattttgttcaagatgaacccattaaactttttctttatcataattaagcccaatatgccaaatgccaaagattagctatcagcttagtacaaaccaggaagctgaagaatagctgtatattcattaagccccaaagagtgtgtttttgttttgttttgatgctaaggaaaggcaggtggctcaaacccagggcagtgtctttgtctccacaggataagcctatttaactcagcttagttcatatcttcagatgcaatccttagcagaccagtgacctcggggaaccctaaagccagacagaccacctgcaggggagagaagcggatcagaggaaggtcacaggtggcatgagtggtgggctctgacaggaataagcccgttaatgggctgttatggaaggaaagctggtcatctggcctcccacccctggccaggagaacctggactgcagtttcaatctcactgcatgccatttagatgtttgtctgcagtgctatctgtggggttcttgaacttgtgacttttaaaagacaatacaaggatggactggtaatgactgacatttagttgaatgaaaattacccagaagtttaccaagcaataaacttcaatctaactagatacccaataaactgtatacaatatgcaaatgcagaattgactgactgagaacattaattattttcctgtggtccaattatgaaaggaaaagaagcttttttactttgctcttttcaaatgcaaagtggttattgggagaaaaaaggctggattcttacaagtgaagcagtataaagaaggggtaggtaaaggagagtggacgaacctactcagagaaggattcactgggcagaggaggggtagcaatgggggttctgctgggctggagacctggactcccaggtagcaccccacttgtgactcacctatgaaggtagcttgtggtgacttgaaggcttatctctaggagctatgacctttgaggctgcatcaaagacccaaattatcaaattagtcacaagagagtagatgccgtgaggagcaggttgttctaccatcaggtgggctatggaaaagtcagcaaacatggctgatggaccaaatccggtcagcctcctgtttttgtaaataaagtttcattggcacatagccaaacccatttgtatacttatgacctatggctgttttcatacttcagaagcagagttgagtagttgtgacagagaccgtatacatagtctgcaaagcccagattatttactagctggctctctactgaaaaaaatatgctgacctcggaacagttagtgtggactgtgggctgagagtagattgcacccgctattctccccttaccctgcagtcaggagatcctttgcaaattttctggagcccttaagtcctccaggatagtcaagtgatccgaggccaatgaacgatgactgatatcacatatctcttcatcttcccaattcttgccagcttagttccagactgaagtatgagatgatattttatatttatattatgagcactgtaacacaaatttatacctcctaggtgcgtcattggtttcctattgttgctgtaacaaattgccacaaactaagtgacttaaagcaacacaaactgattatcttacattttgcaggttagaagtccaaaatcattctgtgtgaactaaaaatcaaagggtcatctgggctcggctcctttggaggctctgaggcggattcagattcttaccttttagaagcctcctctagtcctcagcttgcggccccgtcctccatctccaaagagacagcatcttctctcctctctgacctctgcttctattgtcacatcctctttgactctgatccccatgcttctctcttatcagggcccttgtgattgcattcaacccacctggataatctctctgtcttagatctttaatgtaatcatacctgcaaagccccttttgtcatgtaaagtcacattcccaggtgctagggattagaacgtggaagtctttgaggggcgtcattcagccagtcacacatagagaactttgaggctttgataccaacttcaactctataaagaactgctgagaagccatggctatctagggggaatgggactattctggtcctgtctagagtctctactttctattcattctcaactctcattcaggaaagggatgggtggggaacagcacagacagtcactggttcatagctcttatcagcactgcctgccaagcgagattggccagggacccagccttggcaacggagtgggcacttggacaaccttatttagtaaccttggaggacccctcttgtcctctaccgccctgactcatatttccactccctgggaggggcttccttgtctacatcatgttcctccatggccataccttaggtggacattggggagaatgcctttctaggggaagcaggtgtaggttttgcagtgcagtacttgttgcaggtttagggatcaggacactgctgtgaggggtcaaatactcaaaggctatttgtgaccagactccaactagtgttacagttttcctaaaaaaaaaaaaaaaaaaaaaaaaaaaaaaaaaaaaaaaacgcttctaatttgttatggactgaaatgtgttcctaactcctagtatctcaaaatgtgactctatttggaggtaagctctttaaagggtagttatgtcaaaatgaggttggatgagtgggctgtcatccaatatgctggcgttcttataagaagaggagattgggggggcacggtggctcacgcctgtaatcccagcactttgggaggctgaggcaggcggatcacctgaggtcaggagttcaagaccagcctggccaacatggtgaaaccccgtctctacaaaaatacaaaaatcagctgggcatgaaggcaggtgcctgtaatcccagctactcgggtggctgaggtgggagaatcgcttgaacctgggaggctaaatttgtagtgagccaaaattgcgccattgcactccagcctgggcaacagagtgagaatccatttcagaaaaaaaaaaaaaagaagaagaagaaggagattgagacactaacgcatgcagagagatgaccatgtgaggagaacatcagaagaagatggccacctacaaacaaggagggaggcctcagaagaaaccaaccctgctggcaccttgctctcagatttccagcctccagaaccatgaaaaaataaatttctgttgcttaagctgctgaatgtgtggtgccttatagtggcagcctgagcagactaacagagattctaagcaatgggagctccgtaaggtgtgtgtgttgggggagacatcagagaattgttagcagccgacactcacagcagctgggggcactggcccaggaaagggcttctgggcagccaccaaaacagcatctaccccagcgggcaagtccccagtcacaaaaagacagtgcagattctggagaatcaaacagaataagagctttcgactgctctatgctatgaaacacaaaaattgggacaccaccagaaacttttgaagttggagcttgaagtctctttgcaggcagaatatgttttgccttaaaaatagcacccaatgataacccttatcaacatccattctgcagataacaggcctccctcagggaccatataggtgccattctcccctaaagtcaactgcagcctcaaagagccattgaattcataaggcagcatggagatataggtcatgttttcttccctccaaacctagaagcttgtaagggtacatgctctctagacacaaaataccatatttcctttgcatcttaatccactcaaccctggttgcagtcaccttcttattattcactccatacaagatagatgaattttcacgattttccagtttccgttctggttctcctgttcctggtaggacaacagagaatactatctttctctttcttcaaagattctgtcctgtgagaatgttcctctccagtgatctagtataaactgcaccatccagctctactcatgatttcgctgaccatagattctttgtgacatagtttcttatttctcatttctcctgtgatgttataccctttgtcaagcacagaagaaataatggaaactacattcacctttattttctatgcttgatagaactagtggtgtatagcagttggcatcaaaagatgaaggtacaataagacatttgattagtaatcaaagaggtgaatgaaataagatggaatgccaagttacacagtggtataacccaatggtgagtcggatatgtttttttaaaagcctacacattttcttctgcataggacatcagacaatgaaatacaaacatgtagagtttttttgttacaatcaaagctagaaaagtttagggtattttcttagtaaagagtcttcgtatggttaggaagaggtcttcaggcaaatgtaccatttctctataggagaaatagctctttcttctaacaactgctgaatttagttttcagatattaaatgtgtataaaccgaatggacatccatcaaaaggattgaattggtgcaaaaatgagtgacttttgggcctctctttatggttgctttgagaactgctgcatctaaaagtggactacaatggaaggtgtagatccagcagaggaacacactggggaataagaggggcaattttaagcatgtaggtgatctcaagtaggctgatctcaagtaggcagaccacaaaggatctgaagccaccaacaatgttgagcaaagatgtccagagacacttacgcgggtcctgcattgatggtcatccttgcaggtctatgggtggggtagggctatgggaggctcccagttcaataaaatgaggcaagtatagagaagagggtctctgttattcacaggaccattattgaaatcagttccagatatgtttgagtaataatagttcaacaagagatggattccatgggaaagaaacttgcaaaagactaagaagggaagcaagtctatcaatacgcaatcaggactgtatcccacaaacgaatgctgtagttcctctcttcagtcaggacttactgaggatttgctacatgcattcacgaggtcagcacttggcatcagttgagcagtatcccttcagcagtatccctgaagctaacgtttcagtgggagagcaggtggtgacccttctgtaaagcaggtgaggggctgaagaatggagaggaagggggtggagttttctacagcgtgttcatggaaggcttccctgagtgatacagtgaaaggaaatgagtcacgcagagatcttggggtgagatgggaggaagagggaatattccaggcaaagagacagtgacagttaattttaggtgtccacttaactgaattaaggaatgcctaaaaactggggaagattgctttcgggtgcatatgtagggatatttccagaggagactggcatgtgagttggtggactgagtggggaagggccaccctcaatgcatgtgggcaccatccaatcagctggaggcccgatagaagaaaaaggcagaggaaaggtgaattcaccgtctctcctggagctggggcacccttcttctcctgcccttgcacatcagaattataggctctctggccctccttggattctcaggcctttggcttcagacccagagatacactactgacttccgtggtcctcaggcctttggacctggactgagcttggtttctctagttcttcagcttgcatatggcttattttgagacttctcaaattccataatctcatgaggcacttcctttaataaatcccatctgtctgtctatctatctagctaaatcttcacctatgtttattgtattgattctttctggaggactctaatacaaagactaagtgcaaagatcctgatgtcacaatcagagttgcaagttccagcaacaagaacattggtgaatctgggacgggtattgaaggagatgatatcaaagagacagacagtggctggacatgtgcagctctgtatgggactcccacccttcatgggatggaattccacccttcattgtaggttttgtttagggaagtaatgccatttgatttctctattaagaaggtggctaggtggccacagctgctcataaaatccattctgagatcatcaagtgtaaaacccagtgcatttcatgaagcgttttacttgatgctcacggcaaccccataggagctcacttattatatttttgcctggagtcacacagacagtgaccgaatttggagtcaaaccaagacttgtagaatagccacagtactgcattgcatcacaagggagtgtgggtgaacgggcgagagtaactcagcacagagaaaattagaaagaagtgaggtccaagggttggcctcagctgccatcaccagagagcactgcagtggggattgggacctgaaatccaggaatgggctctagttccattagctcatactagtttgttggctgaggcaagccatttaaatcaatctggacctgctgcttcacaaataaggttgctgaactccaagaccccaagttacattttgctctcggtgatccatatactgtataaatgaagtattacactatcaaaatattttatattgaattttattatggtttattaggttttatagaattaaaaattataggagtagaatggtctcaatcagctcattttatttatttcttagccttatggatgaaaaataatgaaaaccacaaataaataaaaataatatctttgcagccaggcgcagtggctcatgtctgtaatcccagccctttgggaggctgaagtgggtggatcatctgaggtcaggggttcgagaccaccctgtccaacatggtgaaaccccatctctactaaaaatacaaaaattagctgagaatggtggcacacatctgtagtcccagctactcgggaggctgaggcaggagaatctcttgaacccaggagacagaggttgcagtgagctgagatcgtgccattgcactccagcctgggtgacagagtgagactccatctcaaaaaaaaaaaaatcattgcaaatatgtattaatatacattgcatacacagacatgtttcatataaagacatacttgtacacacatacacatactcccccagccaccagtacttctgtgtcataaactctaccccagtgtgactggtgctttctggagctccaccaaagagttcctgccccagcaatccctgattttaccctccggagacaatcactgtctaaataggttggctctatctcttgtggacacggaccaagtttactaacttctcagcatcttcaaacactcttgggtatgtctggggaatttctagccttgtgagtcccaccttcccaaagcagaccccaaaggactcagagttgcaactttgacagctgggtcgcaggagttttcaggctccaccaagctgatcctcacaccctagaccctcccttgagaaggatcagcctgaggaaggaggctccaccgggatctacctttggtggaggcatctgactcctggaggtgacagcctgctgttctagccactggagcaggtgcaccatgggacgtagggtagcagcagctgtgtccaagcttgacatcagggcaaactgtagcatcccaggcttagtgacagggggtagggggactctcactgtcaggccaattcctggaagcagagagcctatttctctaggcctcttaaggatgtcgtggacaccccagtctactctttttcactgaatccaccataatgaactatttttcacttgtaactaataaaacggtgtgatcctgactgcccaatacttgttgaaacatgtctccagagcctatacacatttaagcaacatgtatttttatacttaacaatggaactcagctgtacacactggaaagcttagacccattctttctttttgactgccccatggtatttgatggtattgtattggtgaagcatactttgcttaacaagccccctattgctttacatttaagagatttttcttatttttactgttctatacaatgtagcctgacacacatttgtcgttttcaattcactctgtggctttcgtacagattactaaacagtaagattgctgaaagattatatatgcacagtaaaatttttaacatataaaaacaaattttattttcaaaggttattccaatttatacctgcattaaatatttatgaagacaccaatttttccccacccttgctaatacttgatgttattagtcctttgaaatgttgccattttgaaaggcaaaactccacctcattttaatttatatttttaaatttattagtgatttttagcatatttttacatatttactggccatttgtatttttcttctgttttacctatttatatttgcccattttctatttttttactgacagagatcacattatatgttgtacataataatatagcacatattgcatgtaatttgtgtatattctgttgcaaatactttccctaagtctctcatttatcctttaattttattagggtattttctactacacaaagttctatttagcacttgctggagtgattcaactttagaggatttaacaatataattaagtaaattaataaataatttgagtaaaaaaaaatcacatcaaatacaaaggaaaaaagaattattgaattgagacaaaattgttcattaaaaactttaagtaaagtaaaacgtttgattaaatactttaggtaaaactttaaaaaaacttcttaagatgagtttcgaatgctatcagaagtcattatgaaaacattactctaaactggaaaatcctcaatgcattctgactgaagttggaagcaggacgaagtgtagggtatctcctcactataactcaattgtgttcaggaggttttagctaatgcaatcagatagaattaagtgactgatataaactgaaagagagataaaagcagtatcactctttgcagataataagattttactcctagaaaatgcagggggtaaaactaaaagaaaaccttttagaactaattttcctttcaaaaatttcacaggaaggtgtcactgtgtaagtagtgactttgaaaccctcaacagctttcctctatgctagtagtaactatttagaaattaaaatggtaaaagtttctattcatgacagctactaaaagtacaaatggccaaaaataaatttatcaaggaaaatacaagagtagaatgtatatttcaatattaatattttactgaagacataaaataagattccagtaaatggagacatgtcatattcctgtatgggaagactcaacatcacaaaagcttctcaaatcaatgtataaatttaatgcaattccaatcagaattctaatggattgtttatatattctggtcctgcttttgaaactgaataagttgattataaatttcatagggatgaattaccttgataatttctgagaatgttttgggaaattatttttcagatatttaagtgtatgttagagctactctagtcaaaactatatattactagtataggaacagacaagttgatgaccaaaacagaacatagagtccattaaccaatcccaaaatacgtgttttattatggtaaatgatacttgaacaaatagctaatagtttacaagaaaaaatatgcatttatgctaaattaaaaaataatttttggctagattaaagatctagtgaaaagataaaatccatttaatgttatagtaaaatataggagttatgtttttgttgttcagccaagtggggaaggtaattctcactaaatctgataacctggaagacatgcaaaaaaacaaaagaaaaaaaactcaccagatctctttgattatatattaaccccaccatatgataggttaggatataagacctataagtgggaataagtaactcatgcaagatcactggacttggcagagagacagaataaagggctaatcagatggtcagagtgtttaagtggtatgagctacacacttttctctttcccagtcgttcataaactttaatgaacattaaaaaccacctggagtgctcattaaaatttacctgactcccactcccagtttctaatttaatagatcagattagggactgaaaatttgcatttttaataagttcataggtaatgtccatgctgcagagtgtagcatcacttggagtaataatttgctatgcaacttccttcaacaaaaaatcatgctgcatacacacccacacacacacacacacacacacacacacacataagcttggatgtcatcaaagagcatacattttatgccgagttattttaggggtacatccatgttatgggctagggaaaacttagtctgaggggtgaacaggtagaagggtcaatgtcaaattccatcagggagagaagtatcaggtcaggttgagattacataaaaacaacataattaagacatttcatttatcaaaagaaagttataggatattagtgaaaatggcagtgcaatgacgttcaaaaatctcttctccataaaagtgatgagaaaactggtaaaagttgttggaaacaaatttttctgaactctggaaattaaccaaggcttggaataacctggagagggttcattcaagaaaaaatggctgaatttcaggaaggccagtgagcttagggcattttaatagtctcattccctgctctccaggtgcacagtaatcttgtaaaataaaactctgcattcctattgcagcctggcagaacccccagaggtaacagaatgaagctggagatcttacaaagctccacttccaaataattgccctttaaaaagaaacctatttcatggtttcctggaccgttcccacttacaaggctgtctgtatctgacctgacttagagactgcccaatacaaaaagccttctccccaaggaacatttgttgagaacaattaataggcacatattttaactttgtaactgcttgaggtggtgaatagcagttgaaacaaccaataggctagccaaaaaagctgtaaaagaaaagctggggcatgagatagtcctaggacttagaaaatcctgacctattcctgggaatctagaaggtcatgtgtatgtcaatattggccacatgctccaggctgtgtgcatgctgaggaaagacctgagaaggtcctatgctctcacctctcgctgaccttgaggctctgtgaaagcagaaagggaaagctaggcaatattgtcaactgcctgactgagtgttgaagaagtgttctaacacatgaatatagctccttggcagaaacagaaagatttattggttccagacatttgaggaaacctctatctaatcattagctacagagacttcagtagccacacatggaaaataatacagattttgcagaattagtttagaaaaatccctaaataaacaaaaataactaacaactacaagcagcaatagctataaacctggagtggggaggatctaattttcatgattgtcaaattatattattttaaatgtctagtttccaacaaaaattgtgagacatgcaaagatacaagaaagcatggtttatatgcagttggaaagacaagcaatcagtagaaattgtctctgaagaaccccaaacgttggacttactaaagaaatactttaaataagctgttttgttcaaagagctaaaagaaacaatgtgtctttgcttgaacatttttgaatatgttcaaagagccaaaagagacaatgtctaaagaactaaggaaaagtatgatgtgtcagcaaatagagaatattaataaagaaataggacttttatttggaaaaatcaaatagaaattctgcagttaaaaagtacaattaatgatatgaaaaattcactagagggctcaacagcagagatgagcaggcagaagatagaataaatgaacttgaatatagtgaatagagattatgaagtatgaagaacggaaagaaaacagaacaaagaaaaatgaacagagcctcagagatctgtggaacaccgttaagattaccaacaacatatgaataatgggaaactcagaagaactggagagaaataaaggggcagaaagaatatttgaagaaataatggctgaaaacctttccaattcgatagaaaacatttagctacacagccaagtagctcagtgaattgcaagcaagataaactcaaagagatccacaagtattcataatcaacctgccagaacccaaatacaaagagataatcttgagagcatcaagagagaagcaactgatcatgtacaaggaattcttatttagattacaaagagataatcttgagagcatcaagagagaagcgattgatcatgtacaaggaattcttatttagattacagctgatttctaatcagaaaccacagagaacagaaggtaataggatgacatattcaaggtgctgagagaaaagaaaatgtctaccaagaattctatatttcgcaaagctatgcttcaaagataaaggagaaattaatatttttccatctttaggaaagctttgtatagccaccatggctctgatctcatcttgaattgtactgtcataattcccacatgttgtgggaggggcccagtgggagataattgaatcacgggggtggtttccctcatactgttttcatggtagtgaataagtctcacgagatctgatggttttatcaggaatttccacttttgtgtctttctcattctctctttgcctgctgccagccatgtaagatgggacttgctcctccttcccttccaccatgattgtgaggattccctacccatgtgggactgtaagtacaattaaacctctttcttttgtaagttgcccagtcatgggtatgtctgtatcagcagcatgaaaacagactaatacagactcactcctgtaatctcatcactttaggaggccaaggtgggaggatcacttgaggtcaggagtttgagaccagcctgggcaacatagtgagacctaaattctataaaaaatttagaaatagctgggccatggtgttatgttcctgtagtcccagctacttgggaggctgaagcaggaggatcacttgagcccaggaggtcgaggctgcaatgagccataatcaggccactacactccagcctgggcaacagagtgagaccctgtctctaaaaaataaatacatacatacagaaataaaaattaaaaaccaagataattagtcactggtagacttaccttactagaaatactaaaggaagtccttcaggcagaaatgaagaaacactaggcagtaacttggattcacgtgaagaaataaaagagcgacagttaaggtaataacacaggtaaatacaaatgacacaatcattgtaagttttatttgtaactcttttctctgatctaatttaaatgacaactgaataaacaattataaatctgttgatgtataaacaatggataaggatgtcacttgtgataataacagcacaaaaaaggggcagacaatgaagagcaaagtcttgtgcactgttgaaatgaaattggtatgaatctgaactagtttgttataaattaagatgtgacttgtaatccccagaacaatttatatgaaaatcactataaatatatggtaaaatacatgaaaagaaaattaaatgatacactagagtatatttaacaaaagaaggcaggagtaaaggaacaaaaaagacatgaacatgtagaaaaaaatagtgaaatgtcagacttaaagacaaggtgaacattcttgtctgtggtacaaggactgagatggattgatgcaaacaacagcttgccaataccaggagatcaataggagtgaggaaggagcaggagagaaatactcctagaagcaaatccatggtggtaaatcctgtaccctcgaccccaccaggtagtcccatttgtccgccctgcaggctcttgagctgttcctacctgctccagggttggctcccactcagtagtgggtttaccataacaagaatgaagcttacagtaggagacttccttcagagattcagggatgtggcagattcagtcactggccaggtacatggagctctgccccagcccagtagtcaccattacattttgctggtgagaggctacaggaaaggccagagcactggcagcattgccttgcatcttgcagccccagtggcagcctgccccttttggaccgatggggcatcccgagcctgtgactgacttcatggagatggatctgaaggatgctgctcttctccctgcttggggtggaccactcctgcaagagtgagaaggttagggcgagggtgtgggaaactggagggtcacatcctgagagattggaaaattaaaggcccaagctgtctgagggcttggcctaattctccatctcccccaaccccctagagcctctgctcccactagaggctctgagggcttcctttgactctgcacccctctctagtccccaaagaagaacccgctgagcaagaaactgcacagaaagtcaccattgtggattaccagttatgagaggcaaaactgaaagaagcttttctaaactatcaataataacaaaaattctgtcaacactgctagaggaaagatggaattagctttctattctctctgcagaaaatgacattacaaaaccgttgtcataggaagaggcaataaaagaatatgcaggaaaaaaaaaaaacacagagaaatgagtattaccgatttgtgtcaggcagtcaatgacaactgctaacaatttcatgttatttttctggatttaaggtatctatgatatttggtagctttttagtatttaaatttgcacgatttttttcttgttcattatctaattctgtattctttttttttgtctaaagtggcttacaaattgcataagctttagaccgcaaacacctccagctgggcctctacccactgctgatagacgacccccaaagaggccacaggggaaagcaggcctctcgtctcagcagaatctctcagtttcttgttatgtggttggtcagtgtaatcacttttaatttaaaaaacattgtacctcatctgttttgtctcctttgtagtcacacatataatttgtttttgtcttccttttcttcatttaaaagccttatcagaagagtattatttttatttatttatttatttttttgagacggagtcccgctctgtcgcccaggctgcagtgcagtggtgtgatccggctcactgcaggctccgcctcccgggttcacgccgttctcctgcctcagcctcccaagtagctgggactacaggcgcccgccaccaagcccggctaattttttgtatttttagtttattttatgagattttctttaaaaaatgttttgcttttgtagattttgtttctttgttatctaattcaatttctactattatcctcttttactctttctgccaaaaaatacagaccagattttaaacatcaaaacaaaaagctatggctacagtaaggatgaaggccaagtcttcactcccatggcaattttctcctagctaaggcgaggtataaaacaaattaataactgaatgtataatttattgtcaggtagtgattggtactgtgaagaaaaatacatgtaggtaagtggatatggaatgatggaggtggcatctgctttagatgggatggtcagggaaggactttcaagaaagtgatatctgagcagagacctgagtaggtaaggaagagagcaacactgtgtgtgttctgggcaaagggagagcaagtgcaaaggccctgaggtagaaatgggattggagtgtcctagtacttgcaagaagggcactgtgtgccatgcagatcaagtaaggaaagcagagagagaggttccagagctcagatcttatttaaccctattaactatagggagagtaccatttttattctaaataagaaagcaagacaacagagagtgtggggctggagagcgctgaggcagattgacgtataaatctacaacaactgctggtaggaaaacctcccttccatttgattccacttctcagaacttgcttgttggccccagaagcacaaaggagctgggtcccaccaggaacagctgggcagcagtgaatgctggaaaatgagagaggaagagacagatggatgaggattagaggaatcctccaacgggtccagctttgaatgaggcagaaagtgtgaaggtgaatggagagtcactgacacagggacaagttctaagacttggaaaaggaggcagaaaacacagcagaagttagaaggagtctctcttttgcctttattattcatttgttccacaagtaacacacgtcatttgtaaacatattagaaaatacagataaagaagaaaaagagtcattttaaattgcaaatctaaagattgttaggttaaattgcaaatctaaagactgttaatattttggtctgtacagttccatctttcttacacatttacacatatataaacatgtatatatatatatatacatgtatatataatgtatgctttttacacaaatcatatttgcattatactgtcatttttgcattaaatattttataaacatcctcatgtcaataaatgtaggttactattaacattttcaattagtgcaggaagactgctctgtatgtttttactatagtttatttaaacacttccctggtcatttaggtttttttcacattttgccttcataaatggccacgtaacagagctctctaaatttagatgctgggcacttgctgtttcttgatactaaatacttagataggctatcgctaggttaaagaattaaagatttcaaacctctagatatatcagcaaatagttctcaaaaagtcttgacttaaaaattcccccaacatgatgttcctactacccccacaccatcaccagtactggctacttcattattttgcatttttgttatctatccggtcaactgtgacactacttaattgttgtattagtttttatttttcttactaattttcatgtacttattcatcttgctggaactgcctagttcatatcttttgcctactgtgttgagcaggcttgtctttttctcattgcttttgagagttcatattatgtttatagtaattctattacatatgttatggtggtttcccaatgttattttatttttttttaattttttttatacagagtctcactctgttgcccaggctggagtgcaatggcatgatcttggctcactgcaacctccgcctcccaggttcaagtgattctcctacctcagcctcctgagtagctgggactacaggcgcccgccaccacgcccggctaacttttgtatttttagtagagatgagtttcaccatgttggccaagctggtcttgaactcctgatctcgtgatcttcccacctcaacctcccaaagtgctgagattacaggcgtgagccaccatgcccggccccagtgttctattaccatggtgagattttatttccctgtagagatagttttaaatttttatgtaatcagacctatgaagtttctgattgtaatgtccaggttggaaagacttcccctgccccaaagttctatcaatactcattttatatttctggtaaagatttatatttacattttaactcagctggctaccctagtcctactagcattacagtgagaaacaatttaaaaacaaagtcacccagttccactagcatccctccttacaccaacattccctgttccaccagcctccctccttacaccagcattccctgttccactagtactccttgcacacaagctctcctcctgactcctttttctcgtagcttatagagtggcctgagagtaattaatctctggctctgagcacagtgaggctcagcaggctccaatcacataaggcacagtccctaaggcttgcttctatctctcctcaggggagggctgtccccagctcctagagcggccccttgtgtcttctcacacacacagggaggaaggagatgaaggaatgacactcctcttagagagcctgcctatttggcttgacctttccctacatctgtctaaagtactgatggatggccgtactggagacactgttagactctcttcagaagactgtctggaccaccagtgacccttaacacagacaagcatatgctgtggaagagtagcttctagacttttcttcttcctctgcagccacccccatttagtacatgccaccagaaggcaatcagggtatcaaatcattctgtttgagctttgaaaacagtgctttttaaaactatgaatacaaggaagaggtacacttcttaatccccatagaccgttgatcttcccttgagatttctgttcaaatgtcactgtgaattttctactccctaaatttactaaaccaacagcatcccagcacacatgtacatactcggtattattgaaatgctgtcactttggggatagagcagctgtttcttacaggcagtaaacaatggttttgaacaggaagcaggagaaaacatgtccggagaaaactttctgggagaaaaacaaacattgactaagtttgattctggtcaagtgacacagttttatctagaaagtgatatcgcagaaactccatgttctaatatttaattatatgattaatacaatggtcacagattacttaattataaaattgttagtctgcatatttactggtccatttgtaaagtaaaataaatgagttcctctatcactgtcgttctcaaaggcaggggtagggtggggtggggggagcaattttgcctgccagggacatttgacgatgtctggaggcattttttaattgtgacaactgggagggtgctactggcatctagtggctagagaccagggatattgctcagcatcctacaatgctcaggacagcccctgccgctgctcccatcaaaacaaagaatgaccagccccaaatgtaaatcgtatcgagagaaaagtgatcaagaacaattaggaaaggcatctcctacatgttctctctgattttctcccagtttaatgcaagcagaaaaacgttgacctatgcccagaaggacactcgtgacgcaggaaaaatggaaccctaggaagcaggaatcattgccctgctgatgggaaggtcctgggaacatggagtattagaactatgtttatgggggcctagtccagtccctcatcccaggtcttgttccctccatgtcatgacttcagtgccctccacactgtaaaattcaccagtgaacggcacgtgaaaacttccaggctttctgtgggtcggagcatgggcgcatgtcccaagtgctgttgaaccctggtctcgggtcggctcagctcaagctgctgttaccacagctccatcttcagctccttaacatgctcttcctctctacctcctttcttcttttcttctcctggttaagtttaagaacctgcagtcccatccacccctgctccaggaaaacctcagcaacacttctctggtctactcaatccctcctttcctaggggctccttctcttcatctgtgatctcccaggaagcaaaggttcccttgaacccatctaccatcctcttcccaagcctccaactcaccttcttgcaaacatggtttcagctatctcctctgtcattgataataatgtgtgtcacacactgtgctaagaatttgaccctcaatacccttaggaggtcaacattgctattcagcccatggtacagatgagtttgaagacctaggttcaaaccgtggctgtggcagtcactcagcctctgagtctcagattccctatttgtaatgggaccaataacatcttccttgggactcagggttttaaaatataaagatcaagtgaattaaagcacattatcatcatcatcaccacgagtgctttaatgtattattgattcaatattaatttctaaagaaaccaaataaggagacaaggtataatcatttaacatattcctgactttctatctgtgtcaagactttgaagaaatcacacacagggtctgtttccctatgcccagcccagcaacgacaagccctcagggcagggactgtgcaatctgatcacctgagccagaatcctgatggctgagtgattgcaggcaaattataccttccagtaaccctgtcttcttatctggaacctgaggatgaaaataaggatgccctccatgctgtttggaaattcattcaattaatctttgcgatgagctgaggacagagcccaaaccatattacacacaaggtatgttgccaatcttaccacacctccagggaggacttgcagtaagtaacatcgctctctgaaacacccatgcttatggctatgagccatctctgtctgctgtaagccgcccccaagtctctggcctctgctctgcctcttggagtatttctgtctccttccatggccaccctggccagcatgcactggcatcccccatgtgccaagctgcatgccaagggcagatgtggaaggtccagtgacttgggtaatcttggcaggacacagtgggtgcagaatctttcacatgctcattttgtaggtctctaacttgctgaggtttattgagaaaacttaaaagctaattaggttctatgtcaggtcctaagaaaaaggcttaaaaaatgaagatgaaaagcaaaagttactggataattattttaagagagagatttgcaaattaaagtctctctctttgcatctattaaattagcaaatgttaaagaataagatattaaccagcagtgttggccaggatataaaacaccagcacattggtgcacagctagtggaaatgcaaatccatacaattccaataaaaataaatttgccactgtatttcatagccactgatccagtaatcctcattctcagaacctttcttagagaaattgtaaagagtaagaaaaaaatccacaaaggtgcccactacatattatacataatagtaaaaatgggaacaaactcaatgcccctaaataaggaagctgataagtaaatctattaattcatattttcaacaaatatttataaattgctccatttctgagttctctgctatatcagctcaataaaatatcttgtagtcagtaaaatcatcaataataaaatatgtaacataagaagtgaaatgaaattcataaaaatacacttttgccatgattataatgatgccaaaattaaatatttttatttgcagtgtttgggaacatggacaaatcaaaattgctcatttattaagatggtgaattctagattattttcttctccactacttgttattcattattacattatttgaaatgaagaaaaatcttattaaacatgtaaaaacgccaggcatggttgctcacgcctgtaatcccagcactttcggaggccaaggcgggtggatcatctgaagtcaggagtttgagaccagcctggaagacgtggtgaaaccccgtctctactaaaaatacaaaaattagctgggcatggtggcaggcacctgtaattccagctactcgggaggctgaggcaggagaatcgcttgaacccaggaggcagaggttgcggtgagctgagattgtgccgtcgcactccagcctgggcaacaagagtgaaactctgtctcaaaaaaaaaaaaaaaaaaaaaaaaaagtaaaagtccccactcttgcagtcctgtgtgagccctactctgggactcccactcccgatcgtgactctctgcacatgagtggcagcagcggcctggcctgggtcttgcttgaccatggccacgggagggctcagcctgtggacctgaagccactttcccaggaagcccctgcttgtttctccagattgttctgctgtactttatttttgctctctcaaatacgatttaaaaccccaaagagaacacactggagagtcatttcacaagaagtccatctattcatttcacaagaaatgactctccaaacacgttggagagtcatttcacaagaagtccattctattcctataaaagcagggagatagccattcatccttgggatccctctgggaattctttagaagcagtgaggctcaggcctataactgacaagctctgctccgcacattccagtggatctgggtgcaaaagctgaccaagcggctgcgatttgcaggggtggaaacctggaatgtaacaaaatacaaagcatgggaaaaatgtgtggcattttcagtttaagttggccagctgagctagctgaactaagccctggctaaactcatacgtgggcaagggcagctatcaccaaagataagccctctgagagtgccttagagggtttatagctatagatatggaaaccagtcccacccgaaaagacatttttatttttaacattctggaagcatgccatctgtaatcagtttgctcactctgaatgagctcgaatgattcaatcagtctttaaaattctttactacaggcaatcaagcacaactttgatgccccgaggggttagagtttctattccctgatcatttgctccaagcaccttctgttcaaaaaaaaaaaaaaaagaaaaagaaaaaaagaaagaaagaaaaaagaacaaaaaaaagaaagaaaaaagaaaagaaaagaaaagaaatatgctttttaggtttgagtttgacccttaagatgagtttcaaagtaaactctttttaaagacaatgtccatggacttgggttttttttgtttgtttgtttgtttgttttgctgtatttcaatcactgcacgtgcttgtgttcaatggcctgtaaaatgtcttgtgtactctgaaaggagaaggagttcatattggaatggcaattgtctatttggattctaaaagtatctgggtgcacagtatttatctgttagcctaaacacagtatttatctgttaacctaaacataatctgattgtaatggggaagactaattgaggtttaatcatgagttcattcacaatggagattcggtcacctgtgttttccccatgaacaggaccagaatatcctggtagaagtacacctggttctgctccttttcttttttggtagaattttttttttattgtggctatatatatatatatgttatatattgtgtatacatatacatataataacatttaccattttagtgtataagtcagtggccctcagttgtgtaactatcactactatttctggaaggttttcaccattccaaacagaaattctctatccattaagcgatcactccccatttcccctgccccctagccccttgtaacttctattctgctttttgtctctctctgattttgccctctatgtgggatggtacagtatttgtcctttgtgcgtggcttatttctttcagcatcatgtccttagggtttatccatgtcgtgacatgtatacaaacttcattcctgtttaaggagtattccattgtattaacatgcactttgtctccgcatttatctgttggtggacatttgttttatttccaccttttgactattgtgaataatgctgctatgaacacgggtgcacatctatctgttccagttcctgttttcagttctcttgggtgcatatctaggaatggaattgctgagtaatgtagtcattctatgtttaacttattggggaactgccaagctactttccatagtgactgcatcattttacattcccacatggtaggattattttattcccagatatttgctacccttctgtgaggaattccgtatctctcctttttactctgggcttggctgcctgatgtgcaactggatacgacaaaagctttagacttccccggtccccattgttttcactccttcctctagcctgttccaaacaggagctgctcctgcaggagtgtgaacagtaacagggctgctgaacagccacagccagtgcacgacacaagtgagaatgaacctgtgtcttggaggtgctgcagtcctggtgccattttgtcccgcagcaaaagcagctccacatacctttgattgttcccttggcctctcctcttttcacttgtgcatgattctctatggggtttctgtttcctttctttgccaggtacttttacatgtgctgtttcctttttctagaattagctgtcctccaaaacctgtgactgattattagggggaagcatacaaaactgtcattgttgcagatagaaagtcatcaaagtctagcagtttcctaaggttaacataactaaaaacaacaatggcagcagccaggcattgtgctgggaactgggttccactaacccctcagctcctctcattaagcttggaatgattcctaaccccattacgaagatgaggaaatgcgaggctcaggctcatcaagtcacttagctcattagtggtggatctagactccaaatcaggctcttaattaggaccctctattgttcaacgttttccctcccatgcactcttctcttctctggaggggctgctggagattcctcgtgacagtacttgttacagttcccattacctggaggttatattcatttgtgctcacaatggtgaagaagcttagccaagcatgtggtatgtattattcttaatcccattttgcagatgaagaaattgagactcagctcatgacagtgctaactgcattgcacaaaagttgcctaaatcaccaaaataagcaggtgcggttctagggaggagagctgaggagactgggttgttggctttgtgaacgcagtgctgtggcttgcctacagactaatgacctgtcttttaacaggactatacaaatccagtcagcctcccaatctaaaatgtcacactcaaggttccctctctcatcccatagagttgcaaccaatgctgctgaaaacatcatacctcatgatcaaaggcataagtccttagttcaggaatttcaaatattttagcagataagcagtggtattttggagactattaatcatgaaaccaaacttcctgaccaaatcttatatctggtcaatgtttctagaagccaccaggctgggtttcaagtgaagacttactaatttacaatcgcaaatgcagcatctgctgttcaaatgggtgggttttttttgccagaggacattccatgtatttagtgatataaggtcctagtccactgttagccacttatttattttctacactccttttcatctgttcaacctcagaagaatctgaaacgtccccagcagttgtggaatttgggttattcaagtggtgcccaccaagtgccaagtccattctagctacaggacttaatccccgcacactcccaaattcaaattccacctggcacacttaatgtgtgtgcttatcttgtagtactcacaccgatccatgggagggagagaggttaagtcatggaagcaaaagctctctcagaagagcatgcatcccaacttcaaaagtagaaacagagtgacgctgtaccttttttcctcagaaatgttgaagtttgaacaaaatgaatctttagtatttttaaaattgacctgggccaggcacggtggctcacgcctgtaatcccagcactttgggaggccgaggcaggcaactcacctgagtttgggagttcaagaccagcctggccaacatggtgaaaccccgtctctactaaaaatacaaaaaattagctgggcatggtggcacatgcctgtcatcctagctactcaggaggctgaggcaggggaattacttgaacccaggaggcggaggttgcagtgagccgagatcatgccactgcactccagcctggatgacagggcaagactctgtctcaaaaaaagaaaaaaaaattgacctgtcgtcagaattttaagtcaatttttgatttaatattatgttgatgatcttgtggagaaatgtttaaaatagaaacaatataaaacgccaaaaataataaaaggaaacccacacttcattgatataaatacgttttaaattttaggatacaatcgccaattcctgattcccagtcaaaaagattaagtagatccagatgtcacagatgtgaatccacatgtttacatcacatcttgaaaacaatcattattttaatcctaccaaggtataagttgctgtattagtgagagactagttttgtgtagaatgacagcagtaaagacggcagtgaaacaaatgtccatgagctatcttgaatttgtattgactctccccaaaatcttaatgatttcagctcattgaggaaattttcctagtacatacccttctcctggcataaagttttcctagagagtctgcaatttttaggtaagaaagaatattaataataaaaaaggaactttccactgatctcaagtttgtgttaatatgatgttcagtctaactccaaactcattccccagcaagaccctctttaaaacatgtgtgtctccccatcctcgtcatttggatttttctccattatgggtgccatctgtctgtaacatctgtcatccctttgattgccaatgtgaatttcgatggtctggctggtttctttctctcttgcatatttctgactacctgtttctcttctcacccaaagaggtataactccacaaggacaaaagttatggaaactatattttcaaacctaaaatcacaacatccatagcatgagaagtatgcctgtacttaaacatactatggggcaaaacatttgaactgtctgaagcacctaggatgcctggtcatcagcctgaagaagacggatggtagacatcagatgtctttctagcaccttcttgtccggagcattgtatcttcaagcaattgttacacttgaatgagtgactaagaatttaaaaggcatttatcattggtgagacttttgaactagtgtttaacattcaaattgtgactatatatatatatatatatatatatatatatatatatacacacatataattttttttttttagatagagtctcactctatcaccaggctggagtgcagtggcacaatctcgactcactgtaacctctgcctcccagattccagtgattctcctgcctcagcctcccaagtagctgggattacaggtgcacaccaccacacctagctaatttttgagtttttagtagaaacaagattttgccatgttgggcacgctggtctcgaactactggcctcaagtgatctgcccacctcggcctttcaacaaagtgccgagattacagacttgagccaccatgcctggccaatatttatcttcttaaaagtctatttctataagcacacagatttagccttctctgttggtgtcatcatcttcagtcagtggagactgtgcagaacccctgggattagggactgaaagagccaatgtcagaatagagagtgggacagagtaagatagcccttctctcctgatttgggcctgctcattgaatcccaatctaaagtggaatggaataagactgctgggtcccatttcaataagagtctgcctcctagcgcagagactatttggaagccacagccagaagccacttaactgagcagcaagcgctgccacagtctgcaatcagcagtcaactggcctcacctatgggcatgcgattccacagccaagactccccagggcataatgtccagccccatctctaaagctacaacagtgggtacaaaaagatgttgcaccatgatagaggtcaacccactgttcaatgaggacaaaagcaatttggcaaagctggcaagtgcagataagcgtggctccagagagacaaaagctcagtctgttttgcttctcaatttgagcaattagcgtcctacgcaatacccatcaattcaaaagctaggcaacgtttctggaagaaatacatttctaggaaagtagactatgaaaatgtttttagaattgttttattatgaattctttttttaaacatttcttgataacagtataaaaacctagtcatatcttaatagttatctaattagctaacgttattaaagcaggagttgcatgaaatagaatcagaatttagtatcagaaaaaaaaacacatgagagttgtatcatgacaaatttctccctgaatgtttgaaattgctcccactctttcaggtacacgtatcacagattcaaggaacagaatattctctgaacttgagaaaaagaaaagtgacttttcattgtcctttcccccattcagaagcaataattacacccaggatacaactgatcttcccacagctggcttcctgagtgcgtgattagctacaaaccttcctacctagtgggacgtgggaaaatgaaatagcaggaagatggaggctgtcattttgctccttggggaatgaagtgtgaaacctgtgggaagttgagagtacactcagagcttagttcccatgcccaagaagataagtacgtccctgaatctcctgaagcaaaatccttcattggtgtattataaccaggcctgcgtggcttgggttagaaaagctgtatttgggttcctattactggtgattgaaaaatctaaacctaaacctgctttgcatcatcacgcctgaactacaagttaccgctgagcttaagaacattttttacttcatttacttgtctggaagcaaaatggttctgaagctgttttggaaatatacaagtatatctatctccataatttatctatctatctatctatctatctatctatctatctatctatctatctcttagtattcaaaatctcaaccaaacagaaaatgcatttgtgacttgaagcagacggagacacccccagccccacccacctactgatgttgcttcattgggaagacaggcaatgcaggaggagttccaaattaccactctgggttgaaagggtctcaaagtcaggcacacaaatacaaaataaaacatctttgcaagttattgtctgttcagagtgcacagctaggagaaatggaaaacaggcattcagtcctctactcctcctcctcctccatctgtcttcccctttatcagttgattggccatgtcaccatggcatctaggctctctgcaggatgaagtaggagaatatgcttataaggatggagaaggcctgcttgtccttgcttcctttgtgatctgaggagaaagaatggctccactgcctgcaactccaacagacagaacagaaataatatccaggtagacaagaaatgaacagtcagcccgttaaggtcaggaaaaaccatcaaagacaaggcgtcagatattcatggaccatacagcattcatgtgtccttctgacatcacgagttcaaacaagtgcttttctttttcatcaaacttttaattttgaaataattgtagatttgaatgcatttgtaagaaggaatacagaaagaccctgaaccatttactcagttttcccaatggtaacaacttgcacgatgatagtacaatatcactaccaggatattgaaattgatgtaatccatcaacatatgttgtgctttcaaaatcagtttaactgcttgaaaaagtagcatatccacagaaatacctcaggctggataaacaggcctgaaggggacatgttgtatatttatgaacaggctgctttgtctggctgagggaagtgtggcaggcatgggtaaatcattgaatcatgggttctttgaactgatccaacttctctctcactgacagcacttactgtggaggaggaacttttttgcattttgtttcaatttaggatttcctaaaattaagatgagagagtgtccagaagggtatataccaatcacaaggatgaagaacagaaagatgaaccttctgatgtgaaactttagagaagagagaaaaacttttatcatgcagtgggagaagtagaggatcaggaaggacaggatagacagcaacgcgctgatgggtgcacccctgccaggaaccctgctgccggccactgtgtttctcatttgccgggtgtgcctccccagagagaaaatcaagagcaaaacagcaaaaaggaagataagcaatggcactgagaactcagcaacaaaagagaaaatctgtatagccagtgtatcttctttttgaattgtggcattttgggagaaaaatttccttaggaagtatgggaccataaaccctgcatatttgctatggaaaacacaaatcatagatacatatagcagagaccccaggatcatccatgggaccagcttggatatcctcatcttcaaccagatgaagagtgggtgacggacgctggcaaccttggcacaatagaaaacgccgagccatgtggcaagccaaagttccaattcatttataaataagagaattgcacaattcgcagaacacatgatgaattctatgaagaagataacaatcacattaacgtagaagatgaacaactgcagaaaaattctagaaactgccagacaagaaagaaggagatccagcggagccatttttctgtgcttgatcaagtcaatgccattcaccaccacaatgatgccatttgtgaaaatcccaagaagaaattgtatcactgcaagaagaaaatagataatgaggtgagactctagcattttaggaataaaaaattatttacttaaaaaataatgaagttataaagttttggacaggttgggttgttcacgctcttcaattagatcaggactcctctggggaagaagactaacaataaaggcatggggcaggaaggtggtgtacatttgtttatgtcactgctttctctatttagttctgagacagtcaaataaggaggagatactctagcatcaatttgcttcttattgatggcttttgcattttacaggtttacctagctttcaaagtcatcacaggcaaataatggaatcagacaccttcagacagctgggagaacagctcctccatagtaattagccaaagatactcaattcttcatctctactatgaataattgattttgcctacaggtgtgattctacttaatgttatcgtgtactctttaaaaatatacatttttgaaattttcacttatgttatgatgatatggtacaaccagcaacataggactcctgagtagttctccaatatgcaatggttgagcaattcaaaactatctgtaaaatagttatagaataaaatatacataataaaagtatctctaagtataaaatcaaagtaattaggcttgcacatacatgtgtacaccaggtcaaaggcctaaagaaaagtaaggtgtaatgaaatgaagacaagcactcagcactgttcaccctggtcagcatctgcagagtaattcaggggttaaaatcttttctctcttatttttccaaaattatgagagttttatgacatgagctagttgttctagtagaaaagtaaagataaaataatacatgattaaatttgttgctttcagtctgtaatgcactatgaaaaattaagttggtatttcttaatatgtataccgtgctgcctgtaatgctgaagtgggttttctcagtctttacattattgacattttgggctacataactctttgttaggcacgggctgtcctgtgcaatctaggaaatgcagaatgtctaccacatgcctgtcctctacccaccagataccctccccaggctgtaacagccaaaatgtttcgagacattgccaaatgttcaagagtggcagaaccactatgacgggacaaaggtagataaagtatagtttgtaccttccagttatcccaagactaaaggcagaatgagccacatatataatgtgatataaaactaagtcctctctctctctttagagacagagtcttgctttgtcacctaagttgcagtgcagtggtataatcacagctcactgcagcttcaaattcctggactcaggtaatcctcctgcctcagccttctgagtagctaggactatagatatgcaccaccatgcctgactgctttttaaaaatttttcatagatatggagtcttgctacatagcccaggctagccttaacctcccgacctcaagcaattctcctgcctcagcctcttgaggtattaggattataggcatgagccaccactcccagccaagttagttctttagacaattcatcaccagagcacaaagtggggaccaattcaataaacactgggggaattaaagcttctccaacttagcacttaatcaaaaggtacctggcagacctgataatgaagcatatgtcttaatgaacgtgtgttactttgtctaaatgtgtcataaagaatacttaagattaatcttatttttagaaaactggaagggaagtcatattttaaaaaattagtcgtgagagtaaatctgtaggttcttttatggctcttctctgaataggaccatctatgccatcttggactcactctgttcttcctgacacaactacagtgagatgaaggaaagagacaggatcatcttcaaggaagcaccaagggaggtgttcatgagcagatgccatcagaatggatccaaatgcaagcatgccaggaggatgagccttgttttccctccagtagaaagaagaagaaactttgcaacttagaagaaacattctgcagcttagaaaaacagaaatgtaagggcatgcagctatgaaatacaagcatacttccataatactgtgcattaaattctagaccaccaaaatacaagaatattgcaataaggccagtcacactaatttgttggttttccagtacatataaaagttatgttgatactaaactgtggtctattaagtgtgcaatagcactatgtcttaaaaaaagatatacatactttaattgaaaatactttattaccaaaaaatgctaatgatcatctgagctttcaatgagtcataatctttttgttggtgtagggtcttgcttcaatgttgatggctgctgactgatcaggctggtggttgatgaaggttgggtggctgtggcaatttcttaaaataagacagcaatcaattttgtgcattgatgaactcttcctttcacaaaagacctctctgtagcatgtgatgctgtctgacagcattttacccccagtagaactttcaaaactggagtcagtcctctcaaaccgtgccactactttattaactaagtttatgaaatgttctgaatcctttgttgtcatttcaacaatgttcacaacttctttaccaggagtagtttccatctgaagaaattatttgctcatctgtaagaagcacttcctcatttcttaaaaacatcatcataagatgacagcaattcagtctcatcttcaggctctacttctaattataattctcattctatttccaccacatctccggctatttcctccactgaggtcttgaacccctccaagtcatcaggaggtttggagtcaaattcttttacactcctgttattgttggtgttttttttttaacctccttccatgaatcacttcttagtggtatctaaaatggtgaatcctttccagaaagttttcaatttactttgctcaggtacatcagagaaatcactgtctatggcagctgtagccttatgaaaagtattttataaataatgagacttggatgtcaaaattacttcttgatccatgtgttgtaaaatgaatgttgtattggcgggcatgaaaacagcatagatttccttgtacatttccatcaaagctcttaggtaactactcttaggtaactagatgcattgtcaatgagcagtactattttttaaaaacgatttttttctgagcaataggtctcattcattttttatggctgagtagtattccatagtgtgtgtgtgtgtgtgtgtgtgtatattatatatatatatatatatatatatacacaaatgttctttatccactcattcatcgatgggcatttagactggttccatatttttgtaattgcaaattgtgctgctataaacatgcatgtgcaagtgtctttttcatataatgacttcttttcctctgggtagatacccgggagtgggattgctggatcaaatggtagttctacttttagttctttaaataaactccatattgtttttcacagtggttgtactagtttacattcccaccagcagtgtaaatgtgttccctttataccacatccacaccaacatctattattttttgatgttttaattgtggccattcttgcaggagtaaagtggtatctcatagtggttttaatttgtgtttccctgataattagtgatgttgagcatttttttcatatgttgttggctatttgtatatcttgagacttgtctattcatgtcctttgcccatgttttgatgggattattggtttttttttcttgctgatttgtctgagttccttgtagattctggatattagttctttgtcagatgcataatttgtgaatattttctcctattctgtgggtcatctgtttactctgctgatttatttactgtgcagaaactttttagtttaattaggtcccatctatttatttttggttttgctgcatttgcttttgggttcttggtcatgaactctttgcctgagccaatgtcaagaagagtttttctgatgttatcttctggaacttttatggttttaggtgttatatttaggtctttaatccatcttgaggttgtttttataaggtgaaagatgaggatccagtttcattcttctacatgtggcttgccaattatctcagcagtatttgttgaatatggtgtccttttcccactttgtgtttttgtttgctttgtcaaagatcagttggctataagtatttggctttatttctgggtttgcttttttgttccattggtctatgtgcctgtttttataccaataccatgctgttttggtaactatagctttttagcatagtttgaagtcaggttatgtgatgcttccaggttttttattgttgttgttgttgcgtagtcttgctttggctatgtggtctcttttttggttccatatgaattttagtttttttctagttctgtgaagaatgatggtggtattttgatgggaattgcattgaatttgtagattgcttttggcagtgtggtcattttcataatattgattctacccatccatgagcatgggatgtgtttccatttgtttgtgtgatagatgatttctttcagcagtgttttgtgttttaccttgtagagatctttcacctccttggttaggtatattcctaagtattttgggtttttgcagctgttgtaaaagggactgagttcttgatttgtttctcagcttgcccattattggtgcatagcagtcctactgatttgtgtacactgactttgtatcctgaaactttactgaattcatttatctgatctaggagcttttttgatatgtctttagggttttctaggcatacaatcatattactggtgaacaacaacagtttgacttcctctttactgatttggatgccctttatttctttctcttgtttgattgatttggctaggacttccagtactatgttgaatgaaagtggtgaaagtggacatccttgtcttgttctagttctcagggagaatgctttcaactttttctcattcaatataatgttggctgtgggtttgtcctagatggcttttattatcttgaggtatgtcccttctatgccagtgttgctaagggttttaatcataaagggatgctggattttgtcaaatgtttttcctgcatctattgagatgatcatatgatttttgtttttaattctgtttacgtcatgtatcacatgtattgacttgtatatgttaaaccattcatgcatccctagcataaaacccacttgatcatggtggattatgtttttgatatgctgttgaatttggttggctagtattttgttggggacttttgcatctactttcatcagggatattggtctgtagtttgctttttttgttatgtcctttcctggttttgacattagggtgatactggcttcacagaatgacataaggaggattccctctttctctatcttttggaatagttttagttaagattggtaccaattcttctttgaatgtctgatagaattcagctgtgaacacttttggttctggacatttttgttgtgattttttttttttactactgtttcaatcttgccacttgttatttgtctgttcagtttctatttcttcctgacttaagctggagaattgtatattttatccatttcctctagattgtttagtttatgtgtgtaaaggtgtttatagttgccttgaataattttttgtatttctatggtatcggttgtaatatttcctgtttcatttctaattgagactattggatcttctctcattttttcttggttaatctcactaatggtctatcaattttgtttatcctttcaaagaaccagctttttgtttcatttatcttttttgttgtttttgtttcaatttcatttaattctgctctgatatttgttatttcttttttttctgccaggtttggggtttgtttgttcttgtttctctagttccttgaggtatgaccttagattatttatttatgctctttcagactttctgatgtaggtatttaatactaagaactttctcataacactgcttttgctgcatcccagaggttttaataagttgtctcactattaccgttcagctcaaataattttttttaatttgcatctcgatttcattgttgacccaaagattattcaagagcagattatttatttccatgtatttgtatagttttgagagttccttatggagttaatttccagttttatttcactgtagtccgagagtgtacttgatataattttgattttcttaaattatattgagacttgttttgtgacccatcatatggtctatattggagaatgttccatgtactgaagaaaataatgcatattctgctgttgtttggtagaatgttctgtaaatatctattaagtccatttgttctagggtatagtttaagtccattttttctttgttgactttctgtcttgataagctgtctagtgctattagtggagtattggagtccctcatctatctcatttcttaggtcttgtagtaattgttgtataaatttgggagctccagtgttaggtgcatatatatttaggattatgatattttcctgttagactatccatttattttatcattatataatgtccctttttgtctcttttttactgttattgctttaaagtctgttttgcctgatataagaatagctactcctgcttgcttttggcgtccatttgcatgggatatctttttccacccctttaccttaagtgagttcttacgggctgggtgagtctcttgaagatagcagatacttaagtggtggatttttatccattctgccattctgggtcttttaagtgaagcatttaggccatttacattcaatgatagtattgagatgtgaggtactttctattcattgtgctagttgttgccttaataccttgtttttttttttccattgtgttattattttataggccctgtgagatttatgctttaaggagattccattttggtgtatttcaaggttttgtttcaggatttagaactcctttaagcactttttgtagtgctggcttactagtggcaaattctcttagcatttatttgtctgaaaaagactttatctgtccttcatttatgaagcttagttttgctgggtacaaaattcctggctgacaattattttgtttcaggaggctaaaaatggaaccccaagcctttctggcttgtaaggtttttgctgagaagtctgctgttaatctgataggttctcctttaagggttatctgatgcttttgtttcacagctcttaagattctttcctttgtcttgactttagataacttggtgactatgtgcctaggtgatgatctttttgtgattaatttcccaggttttctttgagcttcctgtatttgcatgtctagatatctaggaatgccagggaagctttgctcaattatttcctcaaacaattttccaaactttcagatatctcttcttcctcagaaacaccaattattcttaggtttggccttttaacataatcccaaatttcttggaagctttgttcattttttaaaattcttttttctttgcctttttctgattgaattaattcaaaaacatagtcttcaagctctgaatttctttcttctacttgttctgttctatatttaaaattttccagtgcattttgtatttctctaagtgtatcttttatttccagaatttgttagtgttttaatgatacatatttattttgataatttttcatccatatcctacatttttaaaatttctttaagtttgtcttcacctttctctggtatcttcttaagcagttgaataatcaatcttctgaattctttatctggcttttcagagagttcttcttggtttggatccattgctggggagccggtgtgtgtgatgttttggggtattacagaaacctgcttgtcatcttaccagaattgcttttcttgttccttatttgggtagactatttcagtggagaggtctaaaactcaaggcctgctgttaagattctcttgtcccatggggtgatccctcaatgtggtgctctctttctttccctagggatggggcttcctgacagctggactgactgcagtgattgttgttgctcttctgggtttagccacccagcaaggctaccaagctctgggctgatatcaggggatgtctgcaaagagtcctgtgatgtgatctgtcttcaggtctcccagacatggattccagcacctgctctagtggaggtggcagggaagtgaagtagactctgtgagagcccttgattgtagataggtttagttttctggctttcttgaatgctggttatactagcagtgaagttgtcatgtggacagactcagggcctctgcttagccaggatattgcaggcagtggaattaggtgttgtcttctccttcctggggtcagggttattctgtcctgagttgctttaatgacctgagttggttgtcctccagccgggagatggcactttcaagagagcaccagctgcagtagtagcagggggctgtaagcttgccctaagatggccagggtaattattttggtttctcatgtgatgtgtggggccataaagctcccaagaatttctatgtcttgagtttggctaccagggaaggtagggaaataccatcaggtggagtcagggttaggtgggtgtgggctcagactctccttgagtggggcttgccacagccactgtgggggatggaggtggtggttctcaggccaatggggatatattccagagagaatcttggctacctctgctgtatcatatagttcaccagggaagtgggggatagccagtagcaagaggcctgacccagctcccacacagttggtgaggctggtctcactccagcagtgcccccgctcagtgcccaagaccatgcgcaccccactgggaaagcaagcatggctttcagacctagcccctctccactgcccgctccattggcagcagctcctgtgcttgcttgcttatgcctgcagcagctcccactcacaccccagactctgctcaagaaaatttgtgcccagtcaaaaccattaccaatttctgatgggaacttccttcaccctgtgacccctccgcagttgtattggctggcttccccaagggaccctgtgagatatactcaatgatggcttccctgggctcaagctggagactgggagtgcatgcaaggtactacccgctgctacttctacttttatatttggcacaactccctaaaaccattttatccctaggtaggttaaatccttctcctgtgatctggattttcagattccccagtgggtatgtgtgttcaaaggtaggttttcctcctatcatgctttgggaactcacagttttttgcctgttttgtggaatttgcagcagcacgccactctttcaaaggatctgtgaattattttggttttcctggcatgttcctgcagtggttcttggagcaaaagatcatgatgtgagtctccacacactgttctgccatccatgtggaagatgcacattaggccgttctctgccatcttcccccgatctccaaccttagctaaatcttctgaattgctgcagcttctacataagcacttgctgctttaccttgtacttttatgttagatggcttctttccttaaacgtcatgatctatcctctgctaacttcaaacttttcttctgcagcttcttcacctctctcagtctcatacaattgatgagagttagagccttgctctagattaggctttggcttaaggaaatgttgtggctggtttgattttgtatgagagccctaaaattttcttcatgtcagcaataaggctattttattttcttacacttgagtgttcactggggtagcacttttaattttcttcaaacagttttcctttgcattcacaacctaagcatttggcctatcatggctctcaacatgcctttctcactaagattaaccatttctagcttttaatttaaaataagagacaggcaactcttcctttcacttgaacactcaaaggccattttagtattattaattggcctcattttaatattgttgcaagtcagggaatagggaggctcaaggagaaggagtgcaatgggacagccgggtagagggtcagtcagaacacacacaacatttatcaatcaagtttgccatcttgtttggacacagttggtggtgtccccaaacaattacaataggaacatcaaagatcattgatcacagatcaccataatgatacaaaaataataaaaaaagctttcagatagtgaacgaattaccaaggtatgacagagacatgaagagagcacaagctgttggaaaaatgaccccgataaacttgcttgacacagaattgccacaaaccttcaattccttaaaaaaaaaaaaaaaaaaaaaaaaacagtacctgtaaagcacaacaaagtgaagtgcaataaaataaaatgaggtatgcttgtagggaagccaagaactctcagaaaagcagttactgctagttccttggtttctcagtcaagcgtctatcactgcacctgtcctttctattgcaaatcttggttaacccacctgcgccctgcaacactcagctctgagaagcagatttgtgctttcttctcatcctcagtactcttcattcattaattcacttggtgtttaacataaggtgggtgtgttaagtaaaaccagactcaattatgtaagggaggaaaagaaaaataaatattaccagaggaaaaaaataaatattagcaagccacttagaaagacagtcattgttttctagctctctcttcctggagaacccagaccatgacaccagcatggagttcatccctgtttgctgtcatattgccatgacatttctgtactgatcccgtggtgtgcgccttcagcaaggtcctggcatttcagtattgcaagaaaagtaacaagaacactaaagtgggaaagtgaaaaaaaaaagttcacatcctgagtctaggatagcaatacagtttttcggccctgacaggaaactagcagagataatacatattgcaccaaagacttaaaagaaataacgatgtccaattctatttattagcatgctatttgtctttcggattctaggatcctgaggggccatttggttctcagatattctattacaacttttgttttaactagcttggggagcagagacaattcttcatagagaactttattttgtgtagaataggtcttttgatatgggaatcccatggagtgaaaagtaaaaattcataaggcttgtgctacatttttttcattacataatttctgtcactgtctcttccatgggcacacacagagtctgccaaagattcaccgttcctcactctcttgagactcactcttcttaccctggaggatggaaaaataagagacgtctgtctgtaggtgtgcagcattcatgtgactgctaaactaatgtccccttttgcttcctgaatgagcctcctttcagtgctggggtgaagacccccaaggacatgttctccagccttcctctgaatctactgcatcaatcaagccacagatgttggtcatgctcttgcactaagcaagagtgaactaaatattttaacactcaacacaacaaatacaatttttaaaacaatggcactgagtataaaatccttttaggtctttaaacagtttgttttagtgagaagggcacatcagagaatttctggctctcagatgaaaaacgtatatgtctggcctcacctgtcagtcagtggcttggaacgttgacagttttacatggacaaatagcttggaacagatgggacaagacctgatgtggagaaattcacatgattattaccctgtattaccctgattaaatccattcacttgcactcatcttaatgagcaatcattaaaggagacagcactaaatattcttgaggtaactgacaggcggaaagagttgcttatttatattcaaatcatttagctcctcaaaagaaagtgcgatttttttcacatgcagttagattgacgttggaaagcttttcatcaggtagaaggctgtaatgttcatctttctgctttccggcggcacttggacatttgctttggtattagaggcatcatgaaagtgagtggtggttttaatacctttcccaagtgggccctcacacttcattatcaagggaacaattcctgctttaagaaacatgtgcatgtattaacattgttgtatatttaataagatcattcaaataaggaagaaatagactctgagcaaaccaacccagacatcctttctgaatcttcccgatagcagagctcggcccttgtaaagcctatttggaatttatttcatttaaaattcacaacgtcttggttaaaaagcaccagattctttcaggctaatcattcttcagatccattcatttgcttctctccacttgaatttgcagttgatcttttagactaaaatttttgtctttaatattcaggtcactttcatatacttgtcccttcccttgctcaatttattctagtaatatatttctgtgctttttcttactccactcaatattctgagatgtatttgcaatgcagcaaatagaataatggagcaatgcaatacattgaatttaagtcttccacataaagaactcaaagtgctttacaaacaagaatcccttgttagttacaatgaggaaacagaagccacagatgctgcagttgaatcatgggaatagtctctagtcctcacgattttgtcttcagctctaaactgagttcctccgtggaatttcaaatccttccttgcttcttccctccctccttctctctttctttcccttctttcctttttccttctttcctccctccttctttcctttctttcctttttccttcttccctcccttcctctttatccttcctctcttcctccttccctcccataccccagcacacacttattgtttgtattatgaactaggcactgttctaagcacacagcatttacagccatgcactgcttaatcacagggataggggatacactgtaagaaagtaatcgatagacaattccatcactgtgcaaacatcatagagtgcacttacacaaacctagatggtatagcctactacacacttaggctgtatggtatagtccattattttgctcctaggctacaaatctgtacaacatgttactgtcctgaatgctgtaggcagttataacacagtggtaattatttattatttgtgtagctaaacatagaaaaagtacagtaaaaatagggtacaaaagttgaaaaatgtcatatgtgtgtagggcaattaccatgaatggagcttgcaggaccggaagttgctctgggtaagtcagtgagtgagaggtgagtgaatgtgaaggcgtaggacattaccctactatacactttataaacattatacacttaggctactctaaattcataaaaaataaagtaattgtgctaggacaatacaatggctttgatgtcactagctgataggaatttttcaactccattaaaatctcatggaaccaccattgtatatgcagtccactgttgatgtaaatgttgttatatggtgcacgactgtagtaatgaacaagacaaagcttctgtcatcttggaaatcacactgtagtggggaagaggagagttaaacaagtgaagaaataaataattccaggtaaagtagaaagaggtgctattttagaaagtgtggtcaggaaagcctgacctccccagagaggaggtgataaaagacctggatggaagatctgggaatgaacacttcaggcagagagaggaggaaatagtatcctcactccccatcccatcaataaaagagcttgcagcattccaggaataaacaatgcccagcaaccctgcaatgtgtggggcagtatgaataaggcagagcagagaggaagttagaggggaaggcatggagactgcatctcaccctcaactgaatgggaacccattgaagtgtttgggtgagggggaagctttgttataatcacatttatatcctacaacatttactctgactgctgttatttaaagaaaggcatttactctggagaacatatgtggaggttgggagaaggcaagtgtggaagtagaaataacaactaaaggctgttgcagtagaccaggcaaggcatgttgttagcttaaattaggttggtggtcaagatgggaagaagtggctggacgaggaatagattttgatggcaacaccaacaggaaattcagttggctttgatggggagtgagggaaagagaggaatcaagaaatactcttgggtcattggcattatcccctggtgagcaatggagccatttttcaagaaggagaaggttgaaggaaggttaaaatcaagagctctgtgtggacatgctcctgagacggctactgcaggtagagatgatattatgtcatggatggtaagtttggagtttgtgggaactatcaagtttggaaatatgcatttggaatttgctagcatatagaggatattgaaagccatgaggttggttaagattatgtagggatgagattgccagctggagtatctgagcactgtaaataagaaaccacattttgtgcattcgtgtcacttcgattgtcctgtctgatgccatctctttgtggaaggatgccctgacgagagcagagtaggtgagtcagagcttgcattactgaaagcaattgtggaactagtactagtcatggtttcctaatctctttatgtatggctgattttatttgctgtttcatttagaatttttcctccttctaaggaagattggtctgcagatttttattggtgctatatttaataaatttgattatctatgttatgctggatttatcaaaagattgttaagcttttcttatttctatgcaccagaacaaattaaataacatgggaattatctgtttatttgttggatggaaagaattcacagtgagaaattctggtgccagaggcatttgggaagaggcagaatacttaccaatcatttagtgcttacaacgctaaacaattgaaaggcataacatcaatttgtcctcttgacaattttatgaaatcagtattctttccactttagagattattaagttgaggtgcactgaggtctggaaattgccctcagtcatgcagctaaaaagcagcatttccaagttgtggaccacaatctgatttcaaatgctatgcgtgcatttagccattaagcatcaccgcgtcctatgttaatacccacagtgagagtgaagattcctttcagtggttcaggcataaaatttggacagctgccatttactgcccatctggcatttgtccccttgcctttaccctgactttctttccaggaaccactctcctccacccttgtttatgggccttacttggggctgactccatcactgaatccaggagtagtcacagaaacccaggtgtggcagtcaacatatccattcacctgagcaaaagagatatatccagggataaacatgagacccaaattcatcaagtcagaactaatcccaaaacttctcactgggcaggctctctgcagacaggatggttgcctggcatatccatcttgccaccatgagagaaggacttcagcctgcccaagaatggattccatccagaggacaaaagtgcccagaaaagagaaagcaagaccatgttctcctcagaatatgtcagcctcagaaccagccctcacttactgctggccttgacatttaaatgaacccacaaattctcagttgttactgaagtgggcttgagacggttttttgtcacattgggtgtgctgaaatagttgtggactattatagaaaggtaatgatgtattttctatttctcatagttagtaactggaaccagacaaattatctgcctaaagccagtcatttagtgaagtaactagggcccatacctgtgacttgtatattagagttttgagtattctattcactagatcatacagttttctcaaacatatctgtggaagttacttagaaaaaataaaatacaaatttcttttctggattctttccctatacatttagttattcattttccatcacttagttactctgacggctcagattttattgtgctatagaagagttctcaaagcataaggttaccatatgggcatcagaagttttattcattccaaaccgaacagaatgtctttggcattgactggctatactttgttcaaaagatgcatggtcaaatatattttcatatgaatttgcatatatgtggctgcacaaccattggattggacacatggaagatgataatgtgtgctcttgaaacaagcagtgccatttctgccctggtccaaactcaaatggttctcttttgtcgtaggagtcaaatttatttttcctgcccttcaaagatacaatacttccttacaaattacctcgcaaggatagaactgggtatttcagattttcatatatagaagctgccctgggtcttgctgctgcctctccccttcaaagcagctgtctccagatacaggattgccagcttccagaagaccaaaattgttgtgccttgctttgattttccagaatgtgggaccagcctttgtggttacttagttcatgtgttttggggaaactgaagctatctcttgcacccaggaatagacataaatgtgtgggtaaagatagggatgctctagaaacagctgctgaactaacaatgaaaacaaatgaatacaatttctcatctttaggaagtcattgctagccaaactattactatgcaaactatgtaatatttgtcatagcgtataaaatattattccatctacccatatttgtggacatttgtagcaaataagtggggtaaaggatagggactgtgacaatgatatggcatgaatctcactgactcagaggaaatgaaaaaccatgaactcggctttttaaattcaatacagtaaacttaatacagaaccacatcaaatcagatctgtaaaggatattaatgattatttgtgccaactccttaccatatgtgaaaagagaaaatagaatcccaacaaagatgcataagaccctgtaccttgacccaaggactattcagatgtcttgcattctagaaaaaagaatattgtggatttatttgctttagttttgaccagcacagcctccacagaagcatagtccaactcagtgggtggatgttatccacagtggcagctgttatcaccccaaggcaaggctagtgaccatgcttttgaggagagctgtgcaaaccccacatacatacatttgaatctcaccacagttgactgaaaaacctagatataggagtctgcacctcctcctcaaaatgtgagaaaagtaaaaaacatttagcaatggtactcaaggtcctccagccacgtgaatagagcaaaattggtccaatatattttaaattacaatagtagtatattagaaagggaaatataagggaaacttttagttataattttctgtagacattaatatttattcttgtatacatcagactttctacagatagacgccatgataatatagaagattcattttatgaaatattctttctcaattattcacaaatctgaatgttgtcttgttatcgttaagtacataatatgaatttattatctattctccctgcctggcatgaaacatcatttagataatcatagattctactgaagaggaagaaatttgaataatgttaacaagcaattcatggtggggcttttagtcaactttatttttctagttcgacttaacatagtgattcacaaagcttacttcctcctaagaattcacataaccatgaaaaaagtacttttggccataaaacaggatgagatcaaatgtatctcaaaagcaactattgtcagctatattcaaaatgcatcattctttgatctaaaatggagaaagtaagtgtggccatggctacacagcagtatggattggggagagaatacttcaacatgcaagagaaaaatgtgatcttaattatagggacttgtaattaatgcatttcaggcctcaacatttaagttgcattttggtaacttttaagtaaataaaaattttaaatgaataaataaagcttttaaatagtttttaaataaataacttaaaactaagaaatctgtttttatgccttttttccaatctatcaaattgacaatataacagatctgcattgttcctgcatcatttcaggtggcctgaaatttgacaagaagaggacatatgaatgtcttctgtaaggttagatgaagatcccaatgcactgagtcaaggtctctgaatcgtggggaacatgaggtagttaccccaagcagaagcagaggccacatccctcagctcggtgtccagtggccccacattcattcatactgggagatagcagcaaggaatgatactttctttgcaatacatggtactgtcgaaatgaaaaactcaataatcccttacaggatctccatcatttttttcgggggtggggggtagctagggacgtatagactctatactaacaatcttggcccttaactagaaatatcatggccgaccagtgaccttttggatacatatggacctcaagccaaatacagccacagcaaggccacaggctcatgaagaggaagaaggcagggtcggtgcccaggcatccttcgagaagctctgtctccaacttttctcatctggaaagcccctcttccttttgctcattgcaaaatctgacttaacactcttttatctggcagtgcttaaagtgagtttgacctgaggtccacaattgctaattgttgaaagagaactagaaacacttgcttaattccgagggtcaacatcaaaaacaaacctgaccaaagttgcagaggaggtattttacaactaacaacaaccttaacctgacttcgtttatcaaatgtcctcagaattatgatacacccagatctttggcattgtatttttttgtccaccgaacaaaaccgggaagctaccaaaagtcatgcatggaattcatgtgtaccactagcagtgtgtgagatcagcagaatgtttctgaaagctaagagctgtattcaaagaactgatcacaattgcatttgaaataagttatctgccactatttcttttggccataatgtggcaaatgttatatagacaagaaaatatttagtaaaagttggaagtatttgcaaaatatttgtgcagaagtttgcatctttaattgtatgacctcattgtagttgcacagggagactccagctacatcttatcttttcaaaatactcctgagcaatggctttcctacaacctctttggaatgtagcattatcagcttctatttccccaatttcctataattcaataaaaagtcagcaataacatgtccaagggcatgttatctcaaatgtggattttaatgaaacacaaatatgcccatgcatgttttagcaaattgttctggaccatgcaaaaatgcattaaaagtggaggcatatttacatttgttttgcatttgttatttaagaggtcagactatgcaaagtgcatccacttttgtcaatagcttcaaggagaagaaaattttattaaagttagattcatgacaaacagatgagttaatatctgtcatttgggggaaaaggttttgagaggctacatttttaaaataataggcatttattacttttccaaaactgagaatacttaacaaatgtgcctgtctattttaaaccaggtatactggtctgcaggtaaatttccaattaaaaagccaacttaattataagcagtttacagcacaaagggagattgttatatagtctggaattggccctggaaattttaatataaaaaataaaattagtagtagaagaataaaagacatttagtgatttccaaaaacttttagagacaattcttgctcaagatttacaaataaagaatacaatagaaaaatttgtattctaagatgatagaaaacaatatattctaacgttgcttaagagatataatcttacgtacttgctggatttgtttgtggttgcctttgccaaaggaaacttttttcaaaattaaagaattttttttttcctaaaccagcctctgcatttgcccctgaatgctggggaaaaaagggtgtgcaggaggggtgggcacaataaaaactgtgtgtgtgtgtggtgcattttctatacactcccggctatgtaggacggacagacccatttctacagtgttacctggattctctatgtagctacagacctactacattggggattacacaactctatgcctctaatattatgttgggctttgttggacacagcacaccaaggccagggtggacctggtggtgtgcacatatgctgtccgtgaagtctgaagtctaacatacttagaacattccttcttccagaatcacatggattcatgacctctcctaattcatctctatttaaatttcacttcatcacaaaagacttggtccgattatcacaccccacatcaccagcattctcctcatccctttccactgctctgttctccttatttggttagtacttactactatccaacatattttctgtccctcttcctagaatataaagttccattagaacataaactatttttcttcgctgctatatacccagtaactagatggtgcttggcacatggtgggtgctcacaaatttttatggaatgaatgtataattaaatgtttaaaataaaaatacaactgctgatcaatgacactgcagaaaggtccaccagagaatgcaacctgaagattggcagggaagtaattcatgaaatggctattgttctgaacacttagaaagtattaagatttcttctacctgcttctgacagactcagagtataaaaagtttcaaaagactgtgctgtggtgtggagaaattccaaatggaaaaattgaacatattctgtcatcagctcctttcagacagatgctctcaaggtgatcgatttggcagtcctggggagggatgatattacgtttcacatatacatcactggattaatcctcattgtggtattaaatctaattaacataaatctgtgcagtgacttatgttttaaatgatggggtaattatttaaatactttctactatgaagggagttgcgggcttgggttggagagacatagccaaaccagaaataggcaacaaaagactttccagaagaaaaatgtgacatagtccaataatatgagtgttacttaagaacacctaatacgctaaatactgatctgacaaagaagataaattgagaaatgatgattcatattcccaaagatttttttcatgttaatataagcatatttaatggagaaatccataacagattttaaagctttcattttctaaaagagtacgactcaaatttttataaacatatgtatgatatcaatagaggtaaatccatctcatttgagtgagtgcagctccagctttgtgtagatcttgagcatccttggtgagggtatgagaatgaagaacactccggagaccagaagcaacttatgactcaccaaagctctgactgccactcagtagcgttctaagccctccattcattcccattccacttcagtgccaagcatctgagatgggaaagtcatcttcagcccaccaacaagccctgagcggctgggcgtccatctccccatctgtaccagtggcacacatcactgttccattcatcatgtctatgaacttgatctgatttttgtcatgactgtcactataaaagtcactctgcatgagtgtcagaaggaaatttagaggtctgttgctgaggtaatatattttcagatcaaaatgtgggttattgaaatcattatatgtatattcacatgactacatattatcatgttaggagatgggactgatcatggagacatagtatctctctgcatcccatgagacatatctttcttacacaattcccactgctaggaagatcactgaactttccagaaagacgttcaccaaatacgctcttagtgggacccaactacacatcgtctgtggcagagacctacagttctcatgagtatctgagcagctctttttcctggaaacacagctgaacacttcccaggatcccttggattatgtgtgtctctgtgacaaagtccagccaatggaacatgcctagaatcaatgtgggctactccggggctgggcccataaacactacccagttactatcgtcatcctcttcctcttcactggctgagtagagaggattccaaggagctatagggagggggagccacaagacggaaggatgtggcttcctgaataatgggatggagatttaccatggctgcctgcccccaccacacacacaatggacagaaataagagagaaaagtaagcttttattgtattaatccattcaaattcagggcttgtttgttttatgattaacataccctgacaaataaaatgaactttaatggtttttcagaatctgttgcatttcattttctaaaagattacaatgcaaatttttataaacatatgtatggtatcaacagaggtaatccttatctcatttgagtgagtgcaaatgagatatgcatttttcttctgttgcatttacttttctaaaaaatattattttaattgtggtaaaatacacatatcataaaaattgccattttaatcacattaagtgaacaattcagtggcattgggtacattcacattttagtgtgtgttaccatcagccacctccaggatgtttttcactttggaatctgaagctctatacccatcaaacaataactcaccatttcctactccccaccccaactgctagcatccacctttctgcttcctgtctctatgatttgactactctatatacgttttccgagtggaattatatagtattttgccttctgtgactagcttatttcacttggcatgttgtccttcagaatcacccaagttgtaacatacgtcagaatgtccttcctttttatcacccacgttgtaacatacgtcagaatgtccttcctttttatcacccacgttgtagcatacgtcagaattcccttcctttttatcaccaatgttgtagcatatgtcagaatttccttcctttttaaggctcaataatgttccattttatgtatagaccacattttgcttatccattcatttgttgatggatgcttggtttacttctaccttttggttgttgtgaataaagctgctataaacatgggtgtacaaataactgtttgtgaccctattgtcaggctttttgagtgcaaatccagaagtaggattgctggattatgtggtaattccatttttaattttttgaggaatcatcactatacggtttttcacagcagcgacaccattttacattcccatccatagtgcacagccattccaatgtctctatatacttgctcactcttactttctgtttggatttcctaggatcttaacctccagaaaacataaacaaaagaagtgcatgatactgtatcacttactgtcatagattttaatgaatatatctgaaaattcgtttcaaactaagagctattcccaaatattcaacatctactgttctttgcttgataggagccacaaccactctctcctaaaaccaagctttttggttacaagtgatttctgtgtctgcaggtaaggttacagctggctttgtggttagtaaataatctcttggtaacagacttgcttcatctgtaggtgactgtatgaagtcaggccgagggctgagtcagacagctcagctgagctgctctggtggcgtgccatgagagtgtcacagccatatctggagcagattaacaagaaatgtaaattcccttccaaaaatagattccaagaagtagagaacttttaaaattactttctataggaatttccatgatgcctgaagctctaattaaaaagacttataaactctagctaggtaaagaatttttgaaaaactcttcctgcattctctatgtaagaataatacctagtgcttttttaaaataataataataagaagaagaataagaatattttgtgctgttattttcttgggcaaaaatttttagaaggctggaacaatcttgtaattttattctctagccttccaccattcctttacttataaaaaatagcattttaattaaaataatcctgaattccatgcaagattaaacacatgagaatagtcagcaatcttttggaacaaaaaaaaagaataaagagtgactttcactgtcagacacctaagtgtattatgaagcaacaatgatgaaaactaagtgataatcagcccatgggaataagtgcatagtccagaaaggaaaaaatgtccataaaatcattttggtatttaaagcaatggagcaattatgacctatttgatgaagacagtattatatgaacaagtggttaagccactagagaaagataaagttaggttcccattgtctcagaatttacatggaaattaattaaaatatgaaacaagtcttagtaaagatacagaacaataaaaacttccattccttactggtgagactgaaaataatacagctattctggaaaacagtatgccaacttattacgaagttaaacatacattgtgtctgtggtccagcaattctactcctgttatttgtccaagaaatatgaaagcatgttcccacaaaaagactgttataaaaatgctcacagtagctttatttataatagcccaaaatatgtaacaacatgggtgaaacaaaaaaacactgcattaggaagaaggccagacacaacaaagaatgcactatatgactacattcataggaagttttagaataggccaagttaacctatggtgatagaaatcagaagaggaatgtcctgaggcctgcagggtttatgggaagaatgaactagaacaggacatgagggccctttctcagggaagagaaatgttctacattttgattgtaatcatggttacatgaggcatgtattttccaaaacttgtcagtacaaactttataagtctcttatgtatctcaataaaaattaattgggaaaggtttaacatttaaaggaaaagactgacaaatataactacttcaaaatttaaatttctgtaggatcaaaaagactataaataaaagatgagtaataatgagaaaaaaatcattgactatgagacttagtttagtttaattaaatttaattaatttagagagaaatctcaaaattgaaaaaacatgaaaaactgatgaacatctgaaaggaaaaatgaacaaaagttataaataggcaatttgtgaaagaaatatataagccccaaacaaaatttaaacaaaattttaaatgtgtgatgggccaagggctaatatatctctaatgtaaaagggtttatagaaataggtagaaaatactgtatatttggatttttaaaaagcaggcaaaatataggaataaacaattcacaagaaaaaacacacactcaataagtgtcttaaagtgtctagactctctagaaatcaaggaaatacaaattaaaacaactacataccatgtctgaccctgcttctgctttttcctgcctctgtggttttctctttttttttttttttaatttgtttgtttttccttttcagaaccactgattctcaactcaatgcctgggaaacttttattaatgttcaagttatcaacttggacaccacttctcaggtagcttcccctgactctcaatgctaataggagccctgctttgcaatgctataccactcagtacgtcccctagcagagcacttatcacactgcacttactatccagttttcctacaatccccacaaaatcagttctgtaagggcaatgctacagtccaagtgcctaccaagcacagtacctggcacatataggtgcttaataaatattccttgaatgttttattgagtaatatagcattttcaaattgggaaaagctaaagaaaattatcgagtatcagcaagatttaagttgtggcactttcactcactactggtagaagcataaacagttataatgttttctgaagatgtagtagatggagttctccagagcaactgaaccaatcgcatatgtagagagaaataatttaccaaaaagaattggcacacatgattacgtccaagatctgcagctggccagctggagaccagggcagccgatgggataagttctactctgagtctgagtctaactcctaaagcaggagaagatcaatgtccttcctcaaagacaagcagggaaaaataattctttcttgctcagcctttgatactattaagggcttcagaaaattgcatgaggcccagccacgttggagagggcaatctgattgactccaacctgtgattctaatgttaatctcatccagaaactccctcacagacacatccagaaataatgtgtaaccaaatatccgggcaccctgtggcccagtcaagttgacatataaaatcaaccactgcagaaggtaatttgccaacatttaatagaactcataaaaatgcttaacttttttgacctggcagttcagtcttgaacaatgttttctaagaaaattatcagaaatatgtctctgaatacctgttaatggcatctctttgttcattggttgtaagataaaacaaccttaagagtgattgaataaattataaattacaataaaatataattcaaaacttaacgatgatatataatatagacttgcaattattgatataaaaacatattcacaatatgttaaatttaaaagtctatcaataaagacaattgtaatatgatctaattttaattttaaatatacaatatatacaatacaaaatatacaataaaacttccagaaacttaaaatgtagtgtgtcttctttgggtctgaaattatgcatgagtttttttaatttttcttttcattttatgatcctgatatttcctagttttaatttcaatttaattaattcaattaatcatgtaatttcaaacaaccaaaaaactaaccatgtgctttgaaagcttgacttacataggctacatctcaaaagtctgttccactcaggattaaaattaaagcaattagcttagttagatccttttcccttaagcgtttcatttgctgtctactaaaaataccgagctctgattgctttgctcaccagcctaaactattcctcctgatagagcctcagcaggacaagagacaagatgatgtttaggtagaggattgaaagtgatctgaaaaactgacaggtgtggtgtggtatatccatacaatgaaatattcagcctcaaaaaggagaaaatttttgacccatgctacaacatggaggacattaagctgagtgaaacaacccagactcatgaagacagacgctgtattatttcaggaacatgaagttcctagagtagttaaattcttagagaaagtagaatggtggtcagcaggggctggcggggagtggggaatggggagttacttaatgagtgcagggtttctgttttgcaaaataaaaagagttctggagatctgtcacacaacaatgtgaatgcacttagtgttactgaactgtacactgaaaaaagattaaaatggtaaattttatgttatgtatattttactgtaacttaaacaacaaagctgacatatctgactgggggaaaaatcagagtcacacagacttgacttgttgaaggatttagaactgatgagggctgacacagtggctcagtcttcctgccaaatccagggctcctccccttcatcccgccacctttcagaagctgagctctaggcacatcagagcaattaagacagatacttctatattctcaatctatcacccctggaatgaaagcaataatagtagctaacacatacagggtgctgactatttgccaggtagtattcagaaaacactttacatgcattgaccagataattctcacaactctgtgagggaagaattattatgaaatctcattttacagatgaggagcctgtgtctcagagaggttaagtaattttcccaagggcacgcagcctgcagtgggatagctacaatgcaaacgcacgcattatagccctagaatccatgtatataactgttgtaaccatgattcttatactttaaggaatcacctgaaagatttctcaaagctgtttcctggactccatcccaagagagtagttggtgttagggcccgtgaatgtgcctctttgacaagctcaccggtgctgccagtgctgctcggctgagagctgcatgctgagtggaacaaggattgcagcacactgtaagtgttgcaataaagcaccccagttatgttctggaattaaatctagtaaataatcaataatggatgagttacccgtggatcaaattaatttaccccaaatgacttgctattgatatgctcgtatttggtagcaatgtgagttgataatccaatttaaaagctgttacttattcaactctattgcagcaagtatgaggcaatgtgttctcatgacaagacggctgggaatctagagaaatgcaaaaccaaggaatatcatttagtgtaaaaccaccataacagcacaacacggtcttttaatcactacagcatcattttcagatgttacagaagttacagtatgactatagcattccacaaaatcctcacactccccttgctctcagtctatactctgcctttccagaagaggttgccttggatacaagtattgtcatgcctgtaaattttatcccctgtggcaagttagcaaattggcatccaggtttaataaatctgtctgttattaatgaataaatctagtctttctagcaagactcatacccacaatgcttgataacctctgagaaaatgggtaaaaccagttggtggactctcaaagtggacaattgcaccctacacccgtgtgacccaggggagcacagggaccccatgaactactcccccatgggaatgagtagtatccctctctcttgagactctgggactgcagttagtgaggttgggttctgaaaagatgctttcacatccccaattatgactaccactctagacttagaccagctgccctagggagaagaatgacagccccacatttaataatagatctcaggtttcaccttcctcactaggaacaatccgctcagcttagaagctctggagctgttttcccacaccgcaaggtcttctatcggtttgagagcccctggagatggcccacgctggtggcaacgaggcatagagagtcacacgagatcacttagctccccagtcaggtctactgcagtatgagaaacaggggagggaaatgttagctatttaaagatactagaaagaaaaacacatggcgtgaacatttttattaggtcataaggggtcaggcctaatagaagattatcactttattactggattccattttatattaccctgcctgaacaagactctcacgatagcaccaacagatttggctttaatgacttctccctcataatttctaatcacctacacttaaggaccattccccaccacaggaaagtgatggtggggaaatacttcactgcagtgaagacccttaaactcccaagattcagactcacctccctgagccccgagctcaccagtgagtccctcaagactgggtaatgaataacaccaagcattcatctatgaaggagttcctaaataggatgaagtagttaaaaatattttttaagaataattaaaaggcattatggaaaatcctgaaatatttcttttttttttttttttttttgagacagcgtctggctctgttgcccaggctggagtgcagtggcgcgatctcggctcactgcaagctctgcctcctgggttcatgccattctcctgcctcagcctctcaagtagctgggactacaggagcccgccaccgctcccggctaattttttttttttttttttttttttgtatttttagtagagacggggtttcactgtgttagccaggatggtctcaatctcctgacctcatgatccacccgcctcggcctcccaaagtgctgggattacaggcgtgagccaccacgcccggcctgaaatatttctaaacagataaaaaatagggtcaaatatgaactcattcttccttatatagaacatgtcctactagtcactaaggtgcccaggtttcttaattggtttgttctttgagctaatacctaaaagatgactaacatgggaaatgaaacccaatggccgcaacgtccttaaaacccatgcatccaaacatcctgtgcctctgggtagtctatggcaggctgaatgacagtcccccttggatatccctgtcttaatccctaggacttgtgactatgtcaccatacatggcaaaagggactttgcagatatgattaaggctacatatcttgagatgggaaaaaaatgacccttgattatctgagtggatccagtctaattgcatgagttcttaaaataggaaggggaatcaagggaagtgtatcacagagacagcagcatgaggattcagtgcaaatggctggttctgtgaggtaggaaccacatgcaaggatctgagaaaagttataggagctcagggcagccttcacttgacagccagcaagcaaatagggacctcagtcctacacccgtaggaactaaattttgccaacacctgaatgaacaaggtgatctttttctcctagaatctcaagaaaggaacacagcactgccaacatcttcatttcaggttagggaaatctgtactggatttaaagaattagaaaataataattttttgttgttttaacctactacatttttggtcatttgttatggcagcaacataaaactaatgcacagttttcatccaagttatacttctaattaaaaccttaccactttaacaaatcctgttctttctagccacagcctcttagcatgaactccagtttctttttgtaaagtaatcctctataaccttttatactaaactttctatactaaaagcatcagtagatttccttgctgtatttcagcccaaattagctgggcttgactaatcacagcagggtcatttaggagtgacataatcctaaacacaatcctgaaggtgaatgcatgctctcttttctgacattaaaggtggtttcaatcacgtctggcaccgactgaaaaaatgtattctggaatgcctcaggatgaaggaaagaaaaacatagatactgatcttccaacatcgcaatctggttctaatatcagttgtctacaggaagaattcactgttagagaatgatttcctcaagtctatttttaagatccctttaatgtagccatctgctaaattatcttgatacaaatgaggagaatttcagtgaacatctgaatttccttgtttataaaacgaaaactagatcacattccttatctagcctggtgataagaactaatttgatgtatacatatatcagtgtgtgtacgtaaatcatatacacagatttatactacatatacacacatgtgcaccaatcaggataagctagtttatgctgcatcattatctctgcctcaaacaaaccacccaaacttagtgcctgaaacagctcaggtttactccctcccagttctgtgtatcagctgtttggagtggatttggctagaggttcttctgttggtttcaccaggggtcactcatgtagccgcaccatggggtagcatggtccaagacaaatccattcacatgcctgcttgtgggtgctggcagtcagcagaagttgtgaagcctcagaaggcttttactcagaacagcctccatgccatttctcagtcccctttgatgtaagcaagtcacaaatccagcctaattccaaacgggtagagaaagaaaatctactccttgatgagaagagcaataagtcacattgcaaaaaggcacacacggtggtgggaagaatctgttgctatttcaataatccatcattacccccaaatatcaaagatttatttttattcccactgcatggccatcgtggttcactgggggctctgctgcccattactgctcattccaaaatgcaaagtgatggatgattctgccacgcagagcatgctgtgctggttatcagaaccaaggggaaaatgtcagagaagtggcctgcaggaaatgaaatacttccatccaggagtgacagttgtcactcccagccaactctaagtaagtcatatggccacatctaactccagcggagttggaggtgatttcttacaggtgcctgaaagaggagagctcaagtgagaataagtagatcaaacaggtagcacaacatacatgcatgctctcacacacacccatacgtgacatcaatctaatagtttgtcacaggcagctcaaacatttggaactacccaaaactctatccgtgttctggaaatgatagtctctgactataactcagttaagaaagaacaagaagattgatagtgtttttgtcatttccgtaagaaattttgttaagaatactctttcttatttgttccagagataatgatataaatagaattcacttgtcaatacccaattacttttgatcagacatggagggattctatctacaaactgaatcaaaaaatcaattgtcattttgaagtcagtacattatcatttctttgtaattcaaagctgtggtagttagggctgttctcaaatggtctttttctccttctggttgtactttcatccacttaaatgtgatcatgtgactttctttagtcaatacaattctacgttatatttgcatgctattctatactataaagcattattatatataaaaactcataaagttatcaggataataattggaaattagcttaatctcatgcaaactgcaaaaaaagatgattctacaaacaatatatgtgctaaaagaaaaaatgacaagataaataatactgaatcactacaatctccaactaaaattgtctgactcaactaaggcaataaatttttaaaaactgaaatcaaagtagaaatatattttaattgtattatatttcttaatgttttcttatatttaatgttagaatatttgcaagtctacaatggaggaggagagatttataaattccagctgcctataatagctcaactttttcagagacgtaaatttttttcttctaagaagaagtttttcacttcatgtagaagattatactaatatttacctgaacccaaattagggaaggtttatgtcgttgttgtttaacttaatatgctacccacgttaattagctatactgagcttgctttcttattttctcttagtatcccacatttataaagctatgtgctattctcaaaaagttttaggtagcagtccttgtaaggagttgaatgtgacactcagaaaaatctctagaactggtgaatgcaactttatttggatagaaagttttgcaaatgtaattaggttaaaaattttgagatgagattatcctgggttacccaggtaagccctacatccaacaaccagtgtcctgataagagacacagagaagaggggaaggctgtgcacagacagaggcagagactgaagcaatgcatctataagccaaggaatgccaacaattgcccacggctcccagaagctaggcagaggcatggaaaagatttccctcagagcctccaaaaggcaccaacactatcgacaccttgattttggacttctcatctccaggactgtgagataatacatttctgttattttaagtcatggaagtttgtggtggtttgttgtggcactcctaggaaactcagcagcccctatcgaaccatgcctccctcatcgccccaggctggctttcccttccacctcttctatattggcactccccaacaagcgagcagggccatcatctctgaattaacactatctagaattcatttcaccgtctagcctcctttgagttctgcagaaaagcagaggttgttatatcaaatacatcagatgtcaattgcaaatgtaaatttttaatcgtgtttcctttaggtgctgtgatgcatttgatgcagaaacagttgagctctactctaaatgcagagtacaagggacaggggagaaagaaaaatgagccatgcacagtccctccccttccaggcagctatatgaacatgtaagctataaaccacggtatatattccataacgatttccattttctttgctcctgttctgttttccaggactgaaagttgcctctagaagatgccacagtctgctgtcagttattttcttccacccattaaaatgcaaattggtatttctatgtaacatgtgacaggtttggataaaccgtgggattctctcctctcaattctttactgattgaattttaatctggattgcctatcaaaactcagcctattccttgaagttcagataaagtgtcacatccacaattaaaggtctcactgttacccccttacaatgcactttttatacctgagaaatgtgattacatttatttaacttactatgtttcgggcaccatgatttcatttaatcttcagggaacacacctaccattagatactctttacaaatgaggaaacaaacttggcagtgttcaggaacttgtctaaagtaattgtattagtgagctagagatgcataacaaagtcccataaacttaacagctgaaaacaccaatttattttctcatagttctgccagtcaggagtccaacacagaacagatggattctcttctcagcctcttacaaggtgtcagctgggccacattcttttctggaagatccacttccaggctcctccttgttgttggcagaattcaacagtggtagaactgaggtcccattctttgacacatgacctccatctgtgagcaagccatgacatatcaagccctgctcatgccttggttctctctggcttcctctctctgcttttaagggctcctgctcctgcgataacatcgaggccatctgaacaatccaggataatctcctcatctcgaaatcaactgattagtagccctaattacatctacaaagtctcttttccatgtacagtaacatttccctgggtttggcatcctatcatctcagttcccagtgattggggtgtggaatgttcttgggccacgattctgcttaccatagtcactcacaatcagtaagggacagaccagggatttaaacccaaatttgttttagtctttgtaccatgtcctgcttcctctctaggacacaccttaaactaaagctgcagatgttggtgagaagagagagtgtgatgtctaagaccacagcctctgggcagccctgcctgaaggcaaatcctcagccctctcatcagtagaatgagtataaaataatgtctgcctctagggttgttatgagaattcagcggcttaatactcgaaaagggcttgtttattactttgtctggcatatagttagcattgtagaagagatgttaaataaataaaagtaaaggaacataaggcaggagagtaaaagaacagcagtgtagaaggcattttgcccattttattataccatgataattcacaacgttttaaaaggtgaaatatttgtaattgtaacattaccctacttttgagctaatagtttaagatgtagccttgctaggtttcaacctatttttggacaaggagtatgacttatatgcattagatacttactaatcaatcagggagttgaactggattcaggaaagttatataacaagaacttcatgattctttttttttaatattgcctatttccaggcagattattagtggaaaaataattataaggagagatttttcaaaatatgtttaaaagcttttgtttttaaaatgaatttggagagagttctatttattgaagcagatgctctgactggaagcaaaatcaaaatctaattaagaaagagttacaacaatctccatgactgagagacccttgatgggcctagggcactagagctgacataacaatagatgctgggtctgatgtgtgatagggagggctctatgaagctcacatctgcccctaaaatgccacatcccctggccaaccacagctatgctcttaatgtctacaaaatatcttcattgatgttcattatatctgggaggaacaaggggcttcatcaatgaaagagcatccaggaatttatcagatggttgagaggaatgaaagcctgatttcttccttgatgatgatacttacagaaaacagattcaaatttgctagtaaaatcatagcagtgagtaagagtaggaaaaaaataggtggtgcatcttcctattgctgggtggggtgggggcaaaggaaacaaaaactagatctgcagataatagggaaatgaaagaaaagaaagaagaaaacagaaagcaagaaacaagaaggcaaaactaacaggtaacatcagttacaacaacaaatgtgagctgaattcaattacaaaacaaaagattcacagcatcataaaggaaattctattatatactatcccaagtgtatcccacctaaaataaaatgatatgtggtttaaaaataaagtgatgggtaaaatatattaggtacacgaaatcaaacacagaaaagtagagatagcgatattaactaaaaaatcaagctcaaggcaaattttttttaaaaaaagataaaaaaggtccttatatgagtataacaggcatgttccaaaataaaactacatgagacatgaaatattttttattgacttcttgagtccgtttttttctacaaattttaatacatgcataccatgtgcctggcattctgttgaaaactagaaacacatttaaactagacataattacagtcaggactttaaaagtttagatttcaacactcccacttctgcctcaacttgcagcttcctgttgtccaggaaaacaccctgatggcagggtgggcaactctacctacccccacctctcgtagccaggaaagctttacctgttagagcttccagcctagaggctctacctctgcctgaatttgccaaagggtacagcctcctgttgccctggaaatacctggattgcaggacgggcaactctatccaccttacttcttgtagccagatgggccacacctgctagagcttcctgcccagtggcctcacttttgtctgaattctgcaggcaggcataaccgtatgttccccttatccccacttggacagtagatttgggttgacctggaaaggatatagcctgtctgccagctttggcccctgcccgagggagacacatggagcagaacacccaacaaaagaaatgtgggcatgaagacagtaatcaaagagggctcctccaagacccaggagtgaactaaaattgaagccagtcaactgaacccactttatatcacaaagaaacccccaagagcatcaaagaaaataaaaacaaagaaactcacccaaaggataacaaattcaaatactgaaggaacatcagcccacacagatgagaaagaaccaatgcaagaattatggcagctcaaaaagtcagagtgttttcttacctccaaacaaccgcactagttccccagcaatggttcttaaccaggctgaaatgtcagaaatagaatttagaatatggataagaacaaagatcattgacatcccggagaaagttaaaacccaatgcaaggaatctaaggaatgcagtaacatgatgcaggagataaaaaacaaaatggccatattaagaaagaaccaaactgatctgatagagttgaaaaaatcacttcaagaatttcgtaatataacacaaatatcaacagcagaatctgccaagctgaggaaagaatctcagagctccaagagcagttgtctgaaataactcagataaaaataaataaaacaataaggaagaatgacaaaaactttgagaaatatgggactatgtagagaccaaacctaattctcactggcatccctgaaagaaagggagagaaagcaagcaattagaaaacatgtttgaaaatatccttaattaaaattttcccaaccttctagaaaagccaatattcaatcaagaaaatgcagagaacccctgcaagataccttacaagatggcaattcccaggacactaatcatcagatcctccaagatcaaaatgaaagaaaaaaatgttaaagacagccagagagaaggggcaggtcacctacaaagggaactccatcaggctcacagcagacctttcagcagaagccttacaagccagaagagattagaggcctacattcagcattcttaaaggagaataatttcaaccaagaattttatatctggccaaattaagattcataagaaaaggagaaataagatccttttcagatatggaaatgttatgggaatttgttaccactagacctgccttactagaggtccttaagcaagtgctaaatatggaaagcaaagaccattactagctagcacaaaagcacacttaagtacaaagaccatcagcactattaaaaaaaaaaccacacaatcaagtctgcataataaccagctaacaacatgatgacaggatcaaacttgcacatatcaatattaaccttgaatttaaatgggctaaacacctcaattaaaaggcagagtgacaagttgtataaagaagcaagacccaactatatgctgtctataagagacctgtctaacatataatgacactcataggctcaaaataaagggatagagaaacactggcaaagcaaatggaaaacagagaaaaagcaggagttgctattctaatttcagacaaagcagagtttaaatcagcaataatcaaaaaagacaaagaggggaatgacagaatggtaaagggttcaatccaaaagaagacctaactatcctataaatgtgcagccaacacaggagcacccagattcattaacgaagttcttagacaccgacaaagagactttgataaccatacgataatagtgggaaaattcaacatgccactgacagtattagacagatcatcaaggcagaaaactaacaaacgttttcaggacttgatctcaacatttgaccaaatggacctaagaaacatctacagaactctgtaccccaaaacaacagaatatatagtcttctcatctgcacattgcacatacctctaaaatcaaccacacaatggccataaactgtcctcagcaaattttaaacaaccaaaattataccaaacacactctcagaccacagcacaataaaaatagaaatcaatactaagaaaatcactgaaacccatacaattacatggaaattaaacaacctgcttctgaatgacttttgggtgaacaatgaaattaaagtagaaatcaagaaattctttgaaactaatgaaaacaaagatacagcacactagaatctctgggacacagctaaaacagtgttaagagggaagtttacagctgcaaaggcccacatcaaaaagttagaaagatctcagattaacaactaacatcacagctagagggaccagagaaacaagactgaaccacccccaaacctggttttgaaataaccaaaagcaaaactgaactgaaggaaattgagacacaaaaaaacatataaaagatcaaagaatctacaaattgattttttgaaagaataagtaagattgttagaccactagctagaataattttaaaagagagaagataaaaataaacacaatgagaaataaaaaggggctactactaccaaccccacagaaatacaaaaaaaccctcagagactactatgaacacctctatgcacacaaattagaaaaactagaggaaatagataaactcctgcaaacatataacctcccaaaattgaaccaggaagaaattaaatccctgaacagatcaataatgagttgtattaaatcaagtttagcctaaagatgcctccttacattttttaagtttggcctaaagggttctctgttcatagtgaatataacctaaatggaggtgtaaacagactgtaatttactcttgtgccaatcactgagttttgaccaatcaaagagggcaaatgttgaaactgtatttaaataagacaaatgctgagctgtttctgtatcttactactgttttctgtatatcattttccttgttctgtctataaatcttcttccaccatgtggctgcactggcatctctctgagcctactctggctcaggaggctgcccacttcatgaatcattctttgcttaaataaactctgttaaatttaatttggctaaggtttcttttttaacagttccaaaactgaagcagtaataaaaagcctgccaaccagaaaaagcttagaaccagatggattcacagccaaattctaccagatgtataacgaagagctggtatcatttctactgaaactattccaaaaaattaagaaggaaggactcctccctaactcattgtatgaagccagcatcatcctgaaaccaaaacctggcaaagatacaacaaaaaaagaaaactttaggtcaatagctttgataaacataggtgcaaaactcctcaacaaaatactagaaaaccaaatccagcagcacatcaaaaagctaatccaccatgatcaagtagactttattcctggggtgcaaggttggttcaacttatgtaaatcaataaatgtgattcaccacataaacagaactacaaacaaaaagcacatgattatctcaatagatgtagaaaaggcttttgataaaattcagcatcacttcatgttaaaatctctcaacaaagtaggcattgaaggaacatacttcaaaataataagagccatttatgacaaacccacagccaacattgtactgaatgggcaaaagctgggagcattccctttgaaaaccagaacaagacaaggatttcaactctcaccgctcctattcaacacagtactgaaaattctagccagaaaaatcaggcaagagaaataaagaaaagccatccaaataggaagagaggaagtcaaactatctctgttgacagacaatatgatttacacctagaaaatcccatagtccctgaccgaagcttctagatatgataaacaacttcagcaaagtttcaggatacaaaatcaatgtaaaaaatcagcagcatttccatacatcaacaatgtccaagctgagagccaaatcaagaatgtaatcccattcatgatagccacaaaaagaataaaatacctaagaatatagctaaccaggtatatgaaagatctctacaatgagaattacaaaacactgcttaaagaactcagagataaaaaaaacaaatggaaaaatatcccatgttcatggacaggaactatcaatatcactaaaatggccatattgcccgaagcaatttacagattcaatgctattcctatcaaactaccagcatcattcttcacaaaactagaaaaaaaactattttaaaattcatatggaaccaaaaaagagctccaatagccaaggcaatcctaagcaaaaaaaataataataaagctggaggcatcacattactcaacttcaaactatactaaaacacaacagtaaacaaaccagcatggtaccagtacaaaaacaggcacatagatcaatgggacagagcccagaaataatacctcacacctaccaccaagtgatctttgatgaagtcaacaaaaacaagcaataggggaaggactccctattcaataaatgatggtgggataactgattagccatatgtagaagattgatgccggaccccttccttacatcatatacaaaatttaactgatgataaatccaagagttaaatataaaacctaaaactgtaaaaacccttgaagataacctaggacatgccattctgaacataggccctgacaaaggtttcatgatgaagatgccaaaagcaattgcaacaaaaacaagaattgacaaatgggatctaattaagagcttccgcatacaaaacacacaatcaacagagtaaaagacaacctacagaacaggagaaaatatttgcaacctatgcatctgacaaagttctaatgtccagaatctatacggaactcaaacaaatttacaaccaaaaaacaaacgaccccatcaaaaagtgggcaaggacataaacagacattttcaagagaagacatacacacaatcaacaatcatctgaaaaaatgctcaatatcactaataattagacaaatgcaaatcaataccacaatgagatactgtctcacaccagtaaaaatggctactaataaaaagtaaaaaataacagatgctgccaatgttgcagagaaaagggaatgtttatatactgctggttgaaatgtaaattagttcagtcattgtgaaaagcagtgtggtgatttttcaaagaacttatctttgaaaagttcaaaagaagtatcatttgacctggcaatcccattattgggtatatacccaaaggaatagaaatcattctcccgtaaagacacatgcacatgtaagttcattgcagcactagtcacaatagcaaagatatggaatcaacccaaatgcccaccaatggcagactggataaagaaaaggtagtacatatacaccatggaatactacatagcatattaagaataagatcatgtcctttgcagcaacatggaggaagctagaggcattaccctaagcaaactaatgcaggaaaagaaaaccacatattgcatgttctcatttataagtgggagctaaacattcattacacatgaacacaaagaagggaacaatagacactgcggcctacttaagggtggatggtgggaggagggagaggatcaaaaaactacctagtgggtactactattcttattacctgggtgatgaaataatctgtacaccaagcccatgtgacatgcaatttaccttataacaaactgcacatttacccctgaagctaaaataaaagctaataaataaataaaatgtttaggcttaagggtacattaatatgatcataatttaaatatatgtgcagaagaaagccagtggaaggagatacaacaaagcctgtgtaggcattatggtttctttttcttatttatgcttttacttattttataattttctacactaataaatgttataaaatcatcacatatttgtatctaagtggcttctttaaaccctactcactattttttatttataaatactgaaattcaaacaaagtataaaaatcaaaataagtattttaagagatttttaaaattatatattttattttatttcttagccaataagagaagctgaaaaaaaaaacagaatttatccagaaaaaggggaatgaaaaagtttagcgttaccagaggtttgcttttccagttcagatccctctcttggggatcagcaatgaaggcaatagggcaaggaatttcacctgtgcacaaacgaaattcttcttgctgtcccttgtggcacttctccataccctgtctaatggaatggctctgaaacaactgaggctgctccccaggcccagcaaagctcatcccctaaatgagagcaggaagaaatagctgcagcccaatccctgcacccacccattggctcccacccaatgctccagcctctgcctaagccaggagatgctggaggctctgctgaaattttttcatgcgcttctgagaagaggtgatccttcacaaatcatgacatcagcaatatggtcctctcaaagtgtctggcatttggatgcctatcttctctagtttccaatgctgatacagagattgaacatagacatatatgtaacaaaactatggaatagacccaataactgtattttatatgccagctatgtcaggacctactggagagtcaggtcccctatgttcacttgccatttagtcttcaataaagcagtatatgatgatagtatattatgaaatatttcaaatacttaaaaagatatgcaggatattatgataaacaatagtatatcaaccacatggcttaagaaacaaataagtacatcccacatggtcctacacaccatataatccaaatacaatttatcttcccctggcataatgtttatataaaaattatatatggttagaacctggggccagatggtataggcttaagtgtaatctctaccacacaattaagtaatcttaaataagttaccttacctttccatgcttctgttcatcatccatattatgagctgataatagtgtatacctcacaaagatgtatgaatattatgtgggtttaatatatgtaattgtatttaattacatatacatgcattcagttacatatattaactagaattctacagtcctgaagatcatttcttaattatactactttcttaattagactactatctttctaacttctattccatttttcacataacccagaaattcactatttaaaaattaaattatgggaacaagggaagaacatctctctcctcacttctattcaagatcatactgggagttctagctggtgcaataatacaagaaaagaaaattaagggtatatgggctggaaaaggaaaaataaaactgtagctgacattcttgtgtatgtaaaaaattttaaagaatcagcaattaaaaaatcataatgctaataagtcgttatagcaagattgaggatacaaggttaatttacaaaaatttatatacatatgaacaattgaaatttgatattaaaaataaaagcccacttataataacaccccaaaatgaaatcatatatatatatatatatctaatatatatatgtaatttatgtacagaaaactctgatgaaataaatcaaagaagatcaaaataagtggagagatagtctatgttcacagattggaagaatcaatgttaatatgctaatatattccaacttgatccatagagtcatcctaatcccaatcaaaatcccagcaggctattttgtagatatcaacaaacttattctacaatatatatgtatagaaacacaattcattcttgtatgtttattagtaccctgcaactttactgaatccattaattatttttttctttttcttttttttttttttttgagatggagtcttgctttgttgccagactggagtgcagtggcgtaatcttggctcactgcaacctccacctcctgggttcaagtgattctcctgcctcagcctcctgagtagctgggaccacaggtgtgcaccaccacacccagctaatttttgtatttttagcagagatgaggtttcaccatgttggccaggatggtctcaatctcttgacctcgtgatccacccacctagatctcccaaagtgctgggattacaggcatgagccaccatgccctgccccatttattatttctaacaggtttttcttgtgtgtgtgtgtacagactctgagattttccacatataagatcacgccatctgcaaacagaaatcattttacttcttccttctagaggtgtatgacttttattacattttcttgtctaattgctctggctaggaattccagtgttatgttgaattaagtggtacgagtgggaatccttgtcttgcttatgatcttagaagaaaagcttctagtttttcaccattgaatatgatattagctatgggattttaaatatagcctttactatgttgagataaattccttttattcctagcttgttgagagatttaattctaaaagggtgttaaaattttgtcaattttttgcatctatgaagattttcatgtgatttttaccttttattttattaatgtgccatatcacattaattgatttgcatacattgaaccatctttaaattccaaggataaatcccacttggtcatgagtatgatacttttgatgagctgttgaattcagtttgctggtattttgttgaggaaaagaaaactatatatggaaatgccaaagacagaatatccaatacaatgctgaagaagaacaaagctggagaactgactgacttcaaaacttactaaaaaactgcagcaatcaagatagagtgggatgagtgaaagaacacacacagatgaattgaatataacagaaggcccagaaatagacctacacaaaatattcaattgagtttaactatggagcaaatttaattcaacgaagaaaggattgtcttttcaacaaatagtgctggaaaaattgggtatacatacatacatacacaaaaatatagacatagaccttataacttttactaaaactcatgcaaaatagattataaatccaaatataaaatgcaatactacaaaacttctagaagaaaacataggagaaaaatctatgaaaccttggatttggaaataagattttagatacaataccaaaatgtaatccataagagaaaaatttgataaattagactttattaaaatttaaaatattggcttatgaaaaaaacagttttggtgggagtataaattagttcagccattatggaagacagtgtggctattcctcaaagactaaaacaagaaataccattcaacccagcaatcacattactgggtttttacccaaagaaatataaattattctaccataaagacacatgcacatgtatgttcaatgcagcactattcataatagcaatcacatggaatcaacctaaatgcctatcagtgatagactggataaagaaaatgtagtagatacacacaatggaatactatgcagccataaaaaagaatgagatcatgtactttgtgggaacacggatggagctggaaaccattatcgttagcaaactaactcagggacagaaaaccaaatactgcatgttctcatttgtatgtgggagctaaatgatgagaacacatggacacatagaccggaacaacacacaataacacctattggagggtgaagggtgggaggagggagaggatcaggaaaaacaactaaggggtactggcttaatacctgggtgatgaaataatctgtacaacaaatccccatgacacaagttcacctatgtaacaacaaacctgtacttgtacccttgaacttaaaataaagttacaaaaaagagaaccaaaagacaagacagaattaaaaaaaaaaaatttgcaggcctcatatcttaaaaagcatctgtatttcaaatgtacaaaaaactgaaccgatacctcaccaaagaagattagacaaaccaaaggcaaacaagcatgtgaaaagataatcagcatcatacatgattatgaaaatccaaattaaaacattatgttactactacacacctattagagtggcaagaatccaaaacattgacaacactaaatgctggcaagaatgcaaagtgaaaggaactctcattgatagctagtaggaatagaaaatggtacagccactttagaagacagttcgacagttcctcacaaagctaaatgtagtctcatcatatgatccagtgatgctcgcaggtattcacccaattgattagaaaacttatgtccatacaagagcacacatgtgaatgtttcatagcaaccttattcataatcactaaaaaatggaaacaactagttaggcatggtggctcatgcctataatcccaactaaatgggcagctgaggtgggaagattgcttgagcccaggagttcaaagctgcagtgcaaaatttttggaatctatccatctgacaaaagtctaatatacagaatttacaaggaacttaaacatatttacaaaaagacaaacaaccccattaaaaaaatgggcaaaggacatgaacagacatttctcaaaagaagacattaatgcagctaacaaacatatgaaaaaaacctcaacatcactgatcattagagaatgcaaatcaaaaccacagtgagatactatctcatgccaatcagaatggtggtgattaaaaagtcaagaaacaacagatgctggtgagtttgcagagaaaagggaatccttttatactgttggtgggaatgtaaattagttcaacagttgtagaagacagtgtggtgattcctcaaagacctagaaggagaaataccatttgacccagcaatcctattactgggtatatacccaaaggaatatagatcattctatcataaatatacatgcatgcatatgttcattgcagcactattcacagtagcaaagacatggaatcaacccaaatgcccatcaatgacagactggataaagaaaatgtggtacatacacaccatggaatattatgcaatcataaaaagcaatgagattatgtcctttgcagggacacagatggacctggaagctgttatcctcagcaaactaacacaggaacagaaaatcaaacaccgcatgttctcacttacaaacgggagctgaccgatgagaacatatggacacatggtggggaacaacacacactggagcctgttggggggtttgggggagggagaggatcaggaataatagccaatggatgctgggcttaataccaaggtgatgggttgatgtgtgcagcgaatcaccatggcacatgtttacctatgtaacaaacttgtatatcctgcacatgtaccctggaacttaaaataaaagttgatggaaaaaaatggtgtcttttaataggtgagtggataaaataaactgcactgcacccagaaaatcaaatcttattcagcaataaaaataaatgaactatcaagccacacaaacatggagtgaccttaaatgcctattactaagtgaaatgagccaaactgcaaatgctacatcgtgtatgattccaaatacacgacattctataaaagacaaaagtataaggatggtaaaattatcagtgattgtcaggggacagggggaaaggaaggataatgggcgaagcacaggggatttttaggacagtaaaactattctaaataataccgtgatggcaaatacatgacattacgcatttctaaagcccgtagaattttatagcgcaaagaacgaaccttagtgaatatgaatttaaaagatcattttgaggttgggggatcccaggaagaaatttaaaccatgaccagagaatctaactgtactatgaatgtattaaccacatgggtaaaagtgagaagaaaagtttccgacttaagtgactttggaaatgagtaaagtctatgaaacaaaaggcaacaggaactgcccataaacactgtactctagttgataaagttatatcccaaaaataagggctaccaatgctgatactacttacatgtacactggaattgaacaattaaatgaatgtcagatggtggaatccaggtttctcactgtggaagtgagaatttatagacaaacaaggaggaggctagaatgatatatgtggaaaggaattagagttagagacatcagtgtgaactcatgtttagcttaatatggaaataaatggtaacatacataaatatttatagatacatgtatatatgaaggttagcatatgtccctatattcccttgctgtgtcagctgtgcaggtctaatgaaacaacatcccagtagcaatgaggacatgtagcacccagatcttaggttctaatatcattctccagtggaagaagccagggctccctggagaaatggctaattctagtactggggcaggaaatatacatgataagcctagagtatcttatagagtcagatagtaaggaagtgtttaaaggaaaaccccatattaatgggagtgtgtcaaaggcacccaggagccactgaaaaaagttcccaatgaccaaaagttgttaaagattgtgtacaccaaaagagttcttaatgaccaatttgaaaaacaaaataataaaatattactggactataacccaaagcatataataaatattcatgaggccgaagaggtgtaaataagtgattagtaattacatacatttataaatggggagaagagacagtcttacgggtggaagagttcctaataatttatgtagatattctttcctcaagaagggggagcataagttctactcccgaaagtgtgagttgtgcatagcaactatcttccaaaaactgcagtgtcgaaaggaagaaaaaaagaataactgtatagaggagaaacctgaaaaacactacctcaaacaggtgatcaagttcaacatcaacagccacaaatcatgttgataatatgtgcctttgataaaatgagattaaaaaatggcactttacttctgtggtcactcttcaaataatccatagccctactctcatcatgaaaaaaatcatcaaaaaattcccaataaaggggtatcctaaaaaacacctgaccagtattctccaaaactgccaaggtcatcagagacaacaaaaggatcagaaactgccacagtcaagagtaaactgagacatgccaattaaatctaacgtggtatcatggctgggcatggtggctcacgcctgtaatcttagcactttgggaggccaaggtgggcggatcacttgaggtcagaagttcaaaaccatcctggccaacatggaaaaaccctgtctctactaaaaataaaaaaaaataaaaaaattagccaggtatggtggcaggggcctgtaatcccaactgctcggaggcagaggcaggagaatcactagaacccaggaggcgggggctgcaatgagctgagatcgtgccactgcactccagcctgggtgacagagagagactccatctcaatcaatcaatcaatattttaaaaataaataataaaataataaaaataaatctaacatggtatcctgaatggactcttggaccagaaaaaggacactaggtataaatgaagcaaatctgagtaaagtatgcatttcaatataatagtgcattggattggttcattaattgtaacaaatgtactctattaatgtaagatgataaaaatagggaaaaatgggtgtggggcatatggggaccctctgtaatatcgtctaaatgattctttaaatctaaaaacatcctaaaaaattaaggtctattaaaaatttaagttagataatgaaaatttcctttaagccctttaatgtttcctattacttgccaggtaaaattgaaacttcatccttagtactgagtaccatctcttatctttctcccctttccaactcacacctgttcaacatttcaggggacttctcatgtttctgcaaaaaaaaaaaaaaaaaaagatgccctcccacaattacctgctttagagatatttcttctgcatgacattccattatcctagatctctctcagaaaatggcttatctttgaagattcagcttacttgctccctccttagacaagtcttctgtcaccctactataatggattgattgggaacctcttctctgtgcaatttggcaactagagattacaatttagtcctgcttctcagtgtggtccaggagccaacagcaataggcattaccagggagcttgttagaaatgccgaatctcaactcatcccaaaccaaaagaaacaaaagtggcattttaacaagatctccagattatttatagccatattacagtttaaaatgctttgagtatctagaatttagctctccttaagcccttagcacatggttctctggttgttttaattgcctgtgtccttgccaagttatgaaatcacctgaggacaagggttatgtctcattttttttctttatcttcaatatgatcacagtatctggaacattcaggataaccaaaatgaattaatgactagctgaaggacacattaaatgagagt

SEQ ID NO: 3 - DNA, 493053 bp, Homo sapiens
tcccccacccccatataaaaatattaatactttttttttttctgagatggagtctggctctgtcgccaaggctgcagtgcagtagtgcaatcttggctcactgcaacatttgcctcctaggttgaaacgattctcctccttcagcctcccgagtagctgagattacaggtgctcgctgccacacccagctaatttttgtatttttagtagagatgggattacaccgtgttggccagcctggtctcaaactcctgacctcaagtgatccacctgcctcagcctcccaaactgctgggattacaggcatgagccactacacccgaccaagaatattaatacttttttttaaaaaatatcgaagttatttatttatttatttatttatttatttatttatttattttgagatggagtctctctctgttgcccaggctggagtgcagtggcacgatcttggctcactgcaacctctgtccccctggttcaaacgattctcttgcctcagcctcccgtttgccaccatgcccggctaatttttttatttttggtagagacggggtttcaccatgttggtcaggctggcctcaaactcctgacctcgtgatcggtgcgcctcggcctcccaaaatgctggggttacaggcgtgagccactgcacccggccccaaaatctaacgtttgttatcactgttgttttagaaaagaaaggacattttaatgcaacccatgcccatctgtaggggctgaaggtccctctgaggtgattgataaagctgaaaaaagagactatgggaagagaagaggaatattatcaattagctattttagaagcagggcaaactatgagctaggtattcctataaggaaatgaaataatttactaaaaaacatacagcaagaaaataatagagctggagttttctgatttttctgagtccagaatttgtttcactgttctcatttcagctctctctaacaggatgaatgaccttgatttcagaatccccaagcaggtggtgagatccaaaactgagacaaaagaaacggggctgttccaaaaaaaaagctaggtggcaggtgtctaacatgccagggagctaaaacagagtgtgtgagtttcagcagcaggttgaatttagaatggggaaggagaccagaggagacgccagacaggatgactttgtcccattggcctggaggcagccccatgtttctccacccctcatatcactcaccagtttgtaatagtatctttgaatgacgatctgattaaggtccgtctcctccattagtccacaagtttcgggggtacatctactttgctcatttccatatccccagagtctagcacaaggcctggtacatagtaggtgctcaataaatatgttagatgaaaggaagataacacctctatgtactagcagtgagactccaggcatgcaatttctctctgtccttcagtcccttcatctcaaggtttaatttaaatatggtaacgcctgtatgcaactcccagcatccagtaggcactcactaaacacagttctccaccctccttttttcctctgcccctccctcggttttcccactacttcctgcatggtgacacacccatagtttggagccataaaacccaacccaggttggactctcacctctccagccccttctgctccggccctgtcctcaaattggggggctgatgtccccatacacctggctctgggttcccctaaccccagagtgcaggactaggacccgagtggacctcaggtctggccaggtcgccattgccatggagacagcaacagtccccagccgcgggttccctaagtgactggttactctttaacgtatccacccaccttgggtgattagaagaatcaataagataaccgggcggtggcagctggccgcactcaccgccttcctggtggacgggctcctggtggctgtgctgctgctgtgagcgggcccctgctcctccatgcccccagctctccggctgggtgggcttggccatggtcagcgtgaacgcgcccctcggggctccagtggagagttcttacggtaagtggggctgggggaagactggacagggcgggactgcggtcagctttgggaggccatgggacacctccccgtgtgtttcttacgggcccaaagctcctcctggagctcctctggaagggcaggaagccccacggaggcaatgtgaccgcttccctaagctctcaagccggggcatggcctgcttggtgcgagaagtgctgggaggggccgagaagccctggggcagaggcttggctcattttgtctgtccagaggccttcctgggaatgcatctcaggggtctttccaaaaccccacagagggtggggcttggaagcaccgtcctgtttcgatgcggggcaaattgaggtccaccaggagaggcttgctgggcctaggtcacgttgctggtgcattatcaagctgggcgtgggaccgggcagctcggtcgctccgcacctccgttggctctggataatggggaggaggtagaaagcgccgcgcagggtggagcgttggaaaatgagaatatcttgtgcggacgtgtgaaactcagatgcagggctagaaagcatgtgttactgagagtgaaaggctcaggctcactccttagggtgacccccacattggaagcaacccaatgtccctcagcagagggaagacgggtaaataaagcgtgagacgtctttacagtggaatgctatcccattgttcaaggaaacaacgcacatctgtgtgtgacagggaagaacctctcagttaaattaagtgaaaacggtacactgaagaactgtgtagttgctgatagcgaaacggatatagatgtatatatgtacacacgcgtatacgtgtacattccacgcatagaaaattcgtggaatgacacaataaaattggtgacaggtttgtttctgaggagggaaattcaagagaatgttttatcttttggggacacattttggattttttaaaagttgggtgccttttataaacctgttcaaatcacacacccgcacagaacttggtctctggaatccagcagacctcggggtctagttgtgactctgtcacacggctcaacattcacgtgcctcttgctttctttctgaagtggagacaggactaggatgtgtcttaagatcatggtggatgccgtggggaacaaggatgtaaagcccttgataccacgtgcattgcaaagacacaatcaacatttatgtcatcaattgctgaggacagagggccagggaatgacagaatcagggcctgatctcctgactctagtcaggaagaatcttctttgctttgacccccatcaaacaggaatatgtgatgcactggaaatggcagaggctgaagaaaccaacagcctgggaacccatcccacacaccagctgtgtgaccttgggcaagacatttcccctctctgaacctatttcctcatctgtaaaatgaagataacaacaggacctatctcccagagagcggggagattagaggagatagcatagaggagattaagggtgaggccacccttaatccacaattttaagacctggagtatagatgccaatggatgacttggttgaacctgtggctaggggaagacattgtctctcaaaggggccagacagcttctggggaaggacagcccaggtcataaggctaagctaggggtgaacagaaggccccacagtgtctcttaaaggatgatacaataatataacctgacagcctttcactgtctcccacgtctctgcaccttgtaggatgtcctcatgtctcttcatctctgctcctgtgtcatactcattatatagcaaacattcagcaattattagaatggttgcttctatcgacaggtaggtgggtgaatggatggatgaatgggttagtgaatgttctactattatctctcagacagctgtttcattttccaaacggctgtctgagataaataatattgtaatctccaaggacagaagaaaaaactaaggttcaagattaaaaaaaaaacacaaacaaacaaaaaatgtcatctgactcgagacttgacacaatccagctgttgctggccctctgctctaggccacagatatggctggacagagaaaggagaactccagtgaccttgcagtacatccacaaaaaatgagcacttttgtcctggggcagtggaacattcactgcagtgtatgtgtgcctatgtgtatgtgtgtgagagtggctgaaagaccctgatttgatatttttgataaaatacacctgggttagcatcctagatctaccttatttaaaaaaaaaaaacaaaacaaaaaactgtgtggtcttgtgagtcaaatcattacccctctctgagcttcacatgttttatctgtaaaatgagctactgaagtctgctggaaggctccagaaaaaaaaaaaaaagaaaagaaaaatttgctttctgagaaaagaaacaagtgctccgaggaaacaaaacccctctcccaggctgggtgcagtggctcacgcctgtaatcccagcactttgggaggctgaggcgggcagataacttgagattaggagttcgagaccagcctggccaacatggcaaaaccccgtctctactaaaaatacaaaaactagccgggtatgatggcacacgcctgtaattccagctacttgggaggctgaggcatgagactcacttgaacctgggaggtagaggttgcattaagctgagatcatgccactgccactccagcttgggcagcagaacaagactctatctcaaaaaaaacaaaacaaaacaaaaaaacaaaaaacaaacaaaaaatcttcttctggggttctctaatggggataacattaatcatctcctaagatgactatagtagaggtgcattggtgggtcagggacatggcacatagcagagcctcagttagaggcagaggaagacatggctgttgtgaggatcaaatggaaggatccatgagtgcttagaacagtcctgggtccagagcaagcacgcaagaaatcctcgttgtggtttcatgtttttgagctttagcaggattctaaagagctgctctttggtgtggtgatgctgggtggacttggccctccctggacttccggtgcttccacggcacactggttttggctttgcggttctcgtcatcgctctgatcagatagttgctggtgtgaattgtggtgtctggctgccccaccagactataaactccgtgagttctgggacctgggtagtttgttcagccttgtttgtctcactatgtctcacatggtgactggcacagaagaaatgctcaataagcatttgttggatgagtgaaatgatgggcttaaaacagcgctacaatgatgatcatcaatgtcagccagatcccactctcttgccttccttcctctctgccctcctcactgcgttgtctttggtccttgtatttgccccattataacccaaactggctgtcccagcttcagctgtcatgtctgcacttacgtgtctgaagctggaggcaggaggagaagaggttttcctcagtgcccttgtttcttttatccaaaagcaaaacttccccagaaacctcctggcagactcccctagttcaaggaaagctgggaagacaagtatgtagtggaaagagatgggaaagccaagatggacctagaccagtgatttttctcttggggtgtggcacactcctgctccaaacagaactgaggctctggtataaatgagtttctcagcctcagcactgttaactttctggcctggaagattctctgtggtgaggggctgtcctgtgcactgtaggatgttaagcagcatccctggcctttactccccagatgccagtaacatctcttcccatcagttttgccaaagaaaaaatgtctccagaaagccaaatgtaccctggggcacatataaccccactgtgttataggagaacaaggtagttctggggagtgtctaccacaatggagtagagtagactgtgactcttgtgttgttctgctttgagtgccaggatcttgctcagtgccaatctggtactaccctgagtaactctgaggatgagatgctaaacatgcatatctgtgtgctaacctgactcctggccttattacttttctacccttattttccctttaacaagtttcccttggttatttattttgcttctttggtagttgctcatttccgtaagtacctcgaatctccttaaaggaaaggtctgtatctatctcattctttttgttatagtccagccttccacagggcctgatcccatgtagaccttgattgaagattaattaagtggatgaatgaatgggaagatggatggatgaataaatgtatgtttaggtgggtggataggtgaatggactgatgaatgaatgtgatgtgatgaatggatgtgatagatgggtggagggatgcatgaatggaatagagggagaaatagctggatggatgagacaaatgaatgagtaactggggagatggctgggtggatagatgggtggatggattaataaaaagatgttatgggtggatggttgggtgtggaggatgatgcatggatgggtaagtagatggatggaaagatatgtaggtgcatgtgataaatggatgaataagtagctggatagatgggtaggtggttaggggaaggatggatggacaaatgatgtgatgagtgggttgatgaaaagatggatgaatggatggataagaaggggtgggctgaggtagcctggaatagcagcatcttcaagtgctctaaacaggacaagtgaagagataggggatgtcaacaatcttccatcagggcaatactgtatatctgtttttaagtgccaggtgagcctaatttttcctagctatgtaggcctagtccctttgaccaatagcatcagcttgaggacagatcagaggccattgtcggagacagtttggtgatgtggctctgccccttgaagctctatgatgatggtgctttgcttcacttctctggtcctcagtttcttcacccatcaaatgagccttggttgttgtgaagattccatgagctaatgaaagagaaaaggtaatagaagctataacaaacatgccgtgtccttgtgaagggtggataggcccaaaatcgagtaggaccccagatgctggctggctatgggaccgtgtccaatatcaggctatggctgttcccacccttcattcttaaaatatggcccctctccagcccttcccctatctcccctcccacatcaccttcccatcctacgtcaattcagtcttcagcccctatgattcacaaacctggttgcacataggaaactttttaaaacaattttggggctccactccagacccagtgaatcagtctcctggggtgagttccaagagtctgtaattttttgagctccttgtgtgacttagggtatgcagttcagttgaggtatggaaaccattgccttactttctcccatttagtaaacagaggaactaaatatccagagtgcatcttgcctcaacccagaagcctcccgtattcattaattcattgttcatttgttcatttcttcaacaatcttccactggaggcttatggtatttaagacattttgtaaggcactggggaaacacaggaggataaaactttgcttcacgtggtggctcatgcctgtaatcccagcactttgggaggccaaggtgggtggatcacctgaggtcaggagttagagaccaggtagaggcagaggttgcagtgagccaagatcacgccactgcactctagcctggcgacaggagtcagactatgtctcaaaaccaaaccaaaacaaaacaaaaccaaaaaaaaacaacaaaaaaaacaactttgcttcagatcttaaactgtgctcagtttggcaggaggacagacaagccagcagcaaccaaagacagagtgccatgataaggacagcaaaggcactgtgggatacagagggacttaggagaaggggaaggggtcacagacttcttgaccttggaggagtagactgatatctaagctggaacctcggtttagcaggagtcagccgggagaagagacggtggggaagagtgttcccagctgagggaacagcatatgaaaaggcctggagcctggccacacactgctctgattttacttatatttgactgcaattaattccatcctttactgaaagtatcttgagacttgtctggttgtttcatgattgattaatcttattcctaaaagcatgctgaggctgggcatggtggcttattgtggattacacgcctgtaatcccagcactttgggaggctaaggcgggtggatcacttgaggtcaggagttccagaccagcctagtcaacatggtgaaaccctgtctctactaagcatacaaaaattagctggacgtggtgccaggcgcctgtaatcccagctactcgggaggctgaggcaggagaatcacttgaacgcaggtggtggaggttgcagtgagccgaggttgtaccactgcactccaacctgggcaacagagggaaacttgtcttaaaaaaaaaaaaaaaaaaaaaaagcatgctgagatgcttaagtgaaggaattgtgccttccatttttcctgactcatatgcctgtagcataaggatgggtcaatgataacgaaaggaatttgttttcatttaagccccttttatgtaatgggcaagatgttggctatttgatatgttttctcccttttaagccttgcaataacccatccaagtaggaaatattatctccattttataaacaaagaaattgagattcagagttgttaagtcacgtttccctgcatcgccttgcaaataggtgattaaaatctagtctgacaccaaatcttcattctttcagctattatgtcataatagcatccaaggagtttaccaccttctaccacctactagctgtgtgaccttgagtgaatgactcaattctcttttttttttttttttgagacggagtcttgctctgctgcccaggctggagtgcaatggtatgatcctggctcactgcaacctctgcctcctgggttcaaacaattctcctgcctcagcctcctgagtagctgggattgtagctggggttacaagcgcctgccaccatgcctggctaatttttttttatttttagtagagatggggtttcaccatgttcgccaggctagttttgaactcctgacctcaagtgatctgcccgcctcggcctcccaaagtgctgggattacaggcctgagccactgcgcccggccgacccaatcttttttgcctcagtttcctcatctgtcaaatggggttgatgataataccatttacttcacagggttgttgtgagacataaagtcaatatttgtaaagtgctgagtgtctagcacatagaaagtgctatgtgaatttgaacgattattattattatacctatagtgtgtgcatctactatatgcaaaggactggatgcttactaggtgttagcatcattttggctgttgtagaaacaacagagatgagtaaggaatagataactggtcccaggatgcaactgtctctggctggagactaaggacaaggctttgttgcaagccttctggggccctgggatgcccagggtctcctcttgggggtgctggttcatagatgggggcctgtgtggctccttcacagaggaggaggcagatgagaggcatagaaagggaggggacagacctatcctcatcagagacctgggagatggctctggccctggccctgggtagctgtttgtgacctcactcaagtccttctcctgctgtttctccatctactcttttttttttttttttttttttgagacagagtctcaatgtcacccagtggctctatctctgctcactgtaacctccacctcctgggttcaagcaattctcatgcctcagcctcccaagtagctgggattgcacgtgtgtgccaccacacctgacaaatttttgtagtcttggtagagatgggtttcaccatgttggctaggctggactcctggcctcttgtgatcctcccacctcggcctcccaaagtgctgggattacaggtgtaagccacagcacccagcctccatttcctcttttgagaaatggaggtatgacaaccatctggctcagccattgtcacacagtattccctgggtcctaagagtcaggaaagatgctgcagggttccctttgagggtaatgtgggtagggacgtgttcaaatggactagggcttagcctctccccacccttcaacctctggctccatcagagacacttctttttgacttttgtatatttctttttattttattttagagacaggggtctcgctatgttgcccaggctagcctcaaactcctgggctcaagcaatcctcccgcctcagcctcccagcccctgggattacctgctcatgccactgcacccggcactctgttttgacttttaaatgaaatatttaatggagggtctccacagttcaaaaatatttggaaaatcagaagaccacaccagtgtgtttcaaactgcaatcttaacccaggaataggtcatgcaattttttttttattttttttttctagatggagtcttgctctgtcacccaggctggagtgcagcggcacgatcttggctcactgcaacctccgcctcctgggttcaagcaattctctgcctcagcttcctgagtagctgggattacaggtgcccaccaccgcggccagctactttttgtatttttactagagacggactttcaccatcttggccaggctggtcttgaactcctgacctcgtgatccacctgccccgacctcccaaagtgctggggttacaggtgtgagccaccgtgcccagccggtccttcaatttattgggattatattagttcagacaatatagcttatgtaacaagcaaatgcagactttaagttagaagtttattgacctctgtggcatagtcatccagggacccctaaggtcaccctagcccagaaagacactttcacttctactcacattccattggtgagaactagtcacatggcccttgccaaatgcaagggggtctggaagatgtggtccctagcggggcgggactagctgtaaagtttgtaaaggggagcgtgaattagttggtacacagttgatcgtctgtgcagtagggtcatgctcacacgtccctccacacacacacgttaaatatgtataacaagtgtaaatatacaatttaaaaaagtatcttttttttttggtttgtttttgttttgttgttgtttttgaaacagggtcttgctctgtcatgtgggctacagtgagccacaatcatggttcactgcagcctcaacctcccaagctcaagcaatccttccatctaagcctcccaagtagctgggaccacaggtgcatgccaccatgcccagctaattttttatttttatttttttgtagtgacaggtcttgctgtgttgcacaggctggtttcctactcctgtcctcaatcttcctgcatcagcctcccaaaatgccgggattacaggtgtgagctactgcacctggcctttacaattttttacataaaatgtttcaataaaaaagtgcatagatagatacagagatagcaataaagcaaatgtgacagaatgcaaccagttggtgaatttaggcgaagggatacatcagtgctcactatactagtctttcaaactttaaagtttgaaatttttcaaagtaaaatattggagaaaatgaaattcttaaaatttactagacctataagtagactaaaacaataagttataactaaagtaagatttggccggacgccgtggctcatgcctgtaatcccagcactttgggaggctgaggtgggtgaatcacttgaccccaggagttcaagaccagcctgggcaatatggcaaaaacccacctctacaaaaaacacaaaaattagctgggcctggtggtacacgcctgtagtcccacctactcgggaggctgaggcaagaggattgcttgagcccaagaggtgaaggttgctgtgagccgagattacaacaccacactccagcctgggtgacacagcgtaatcctagtgctttgggaggtcaaggcagaaaaattgccaccacacctggacttaaaaaatatttttactgaagtataacattcaaaacagaaaaaggcacaaatcatcaatgtatcgctttatgaaatttcacattttaacaaaagaatgaaataaaataaaatagaaaatatcatagagcatttcatgtagtaagagtaagatatgtatgtttttgaaacttttgttttatttatgtatatttatggatttgtgcttgatgttgtgataatagcaaaaatttatagagtacttactagggttttacacatattaactcctaattctcaaaatgtccctattggccgggcgcagtggcacacgcctgtaatcctagtactttgggagcccaaggtgggcggatcacttgaggtcaggagttcaagaccagcctggccaacatgctgaaatcccatctctactaaaaattcaaaaattagctgggcatggtggcacgcacctgtaatcccagctactcaggaggctgaggcaggagaatctcttaaacccaggaggtggagattgcagtgagccaagatcacgccactgtactccaacctgggcaacagagcgagatcctgtgtcaaaaagaaaaaaacaaaaaaaacagcatactttgtattaggtgaacccacaaagtacaggggccaattgtaggtagtccacaaacacttttaaatctttgtgcatttattgtatgttagaaaaatttatacatagcatattaaagcattaatataaaatatcttttaaaaattaaggtatatcttcaaaagaaaggaaaacatcaagtaaacaattatagataaataaagtacaggtaaaaggcagatgtggtaacaattgtatgaagaggaatacaagtgtctagggcttgggggccacacactaaacctggcatcagaaggcccagatctgggacccggctcatttgttttctagcactaggttgtttttcatccttgtataacaccatggcccaggtactactctaagcactttataaaaattaactcctggccgggtgcggtggctcacgcctgtaatcccaacacttttggaggccaaggtgagtggatcacctgaggtcaggagttcaagaccagcctgaccaacatggagaaaccccatctctaccaaaaatacaaaattagccaggagtggtggtgcttgcctgtaatcccagctactcgggaggctgaggcaggagaatcacttgaacccaggaggcggaggttgcggtgagccgagatcgcgccattgcactccagcctgggcaacaaaagcgaaactctgtctcaaaaaaaaaaaaaaaaaattaacttcttggccaggcacggtggctaacacctgtaatcccagcactttgagaggccgaggcagacagatcatgaggtcaagagattgagaccatcctggccaacatggtgaaatgccgtctttactaaaattacaaaaattagctgggtgtggcacatggctgtagtcccagctactcaggaggctgagacaggagaatcgcttgaacccaggaggcggaggttgcagtgagccaagatcgcaccactgcactccagcctggtaacagagcaacactccgtctcaaaaaaaaaaaaaaaattaactccttggccagacatggtggcgcacacttaaatcccagcactttgggaggctgaggcaagaggctcacttaaggttaggagttcaagaccagcctgagctacaaagtgagaaaataaataaataaataaattactcctttaatcctcacaaccgtctattgaggtaggtactgtcatcatacccatttctgagaaaacaaagtctcagagagactaaatagcttactcaaaaccacgcagcgcatgagaggcggagctagaattcaacatcaaggattgtattagaaaaggcaataccagcttatcaacccaaaacacgagaggagagtttatctctccttcacgcagttgtccagggtccccaactccttcctccctagatggaagatgggctttttttttttgagacataaatatatatatatatgtgtgtgtgtgtgtgtgtgtgtgtatacatatatgtgtgtgtgtgtgtatatacatatatatatatatatatattttttttttttttttttttttttgagacagggtctcactctgtggcccaggctggagtgcggtggtaccatcttggctcatcacaacctccacctcctgggttcaaacaattctcgtgcctcagcttcctgagtggctgggattacaggtttgcattaccacacccagctaatttttatatttttagtagagatgggattttgccatgttggccaggctggtgtcgaactcatgacctcaagtgatccacctgcctcggcctcccaaagtgctgggattataagtgtgagccaccaggccctgccaggaagatgggttttatttgaaccactgggccctactgggatgggtagaattttctgtatcattctgggatccacatcctcctctgaaaatggggttaataatgctagttctatttacccctcagggtagctctgctgctcaaggggatagaggcaagagtgtcctgcaaactgcaaaaagttccttgaatgtaaaatgttagtatgtattgttaatgatattgaccaaagctacattaccatgttacagtgaagattaattgaaacagtgcatggaaagaccttggttcacatacagacaaagtcagctgtgagtaatagccataatagtaatgtggttatgcaatttaaaatattgatttatctccaaattgggatatagttgtataggatctttcttactagcaagttaacacattacgtctataactaaaaaatcaagaagtcttgatttcttgagaagtcagtataaccatgatgtttagaaatacaaacaagaggctgggcacggtggctcacgcctgtaatcccagcactttgggaggccgaggcgggcagatcacaaggtcaggagttcgagaccagcctggccaacatggtgaaaccctgtctctactaataataccaaaaaaattagctgggcatagtggcgggcacctgtaatccctgctactgtggaggctgaggcaggagaatctcttgaatgtgggaggtggaggtttcagtgagctgagatcacgccattgcattccagcctgggcaacaagagcaaaactccatctcaaaaaaaaaaaaaaaaaaaaaaaaaaaaactgggccggccacagtggctcaaaatgctgtaatcctggcattttgggaggatgagtggggggatcgtttgaacccaggaggtcgaggctgtagtgaacaaacatcatgccactgcactccagcttggatgatagactgagaccctgcctcaaaaaaagagaaaggaaaataaataaataaatgaaaatttaaaaggaaaagaaaatatttaaacgctatttcaaacaatctcaaatgtacctggaaacagttgggacaggaagtcatgaagggaatggggcagagttagagaaggtcagagtacagccatgtttcacatcccagctgaaactcctccaacagctttgtatcgcccttcaaatacaacctgagctctttttctttctttctttcttttgtttttctgagttggagtctcactctgtcatccaggctagagtgcagtggcatgatcttggctcactgcaacctccgcctcccaagaagctgggattacaggcgcgtgtcaccatgcccagcaatttttgtatttttaatagagtcagggttttaccatgttgccaggctggtctcaaactcctgacctcaagcgatttgtccaccttggcctcccgtgagccgccgcgcccggccctgggctcttttctttgaccaaaaggctctcacaggctctgactcttgtctgatggtctctcgtctttctccctttggtcactgcagtcagccacactggacttttgttttttttgtttgtttgtttgttttgcgacggagtctcactctttcacccaggctggagtgcggtggcgcgatctcggctcactgcaagctccgcctcccgggttcacgccattctcccgcctcagcccccccaagtagctgggactacaggcgcccgccactgcgcccggctaattttttgtatttttagtagagacggggtttcaccgtgttagccaggatggtctcgatctcctgaccttgtgacctgcccgcctcggcctcccgaagtgctgggattacaggcgtgagccacaacgcccagccacactggccttttgacaatccttcaatcacgccaagcacactcctgccattgggcctttgtacttgctgttctctctgccaggaatgcctcttccccagatctttgcatagctgatttcttctcattgtcagggccttagttcaaatgtcctccactcagagcagcctcccttgaacacccaaatctaagcctgccccacctccatcccttgatagcaattccattatcctctacagcgctgaaattacgtattccttgatctgtttatcatctgtctccttcacagaagttccatgacagcagggagttaggctgtcttgtcccctgctgtatccccagcatgtagaacagtgcttgacacacagtaggcgccccataagtatttgcggaatgagcaaatacagatggggacagctgagtcagtagggtgagcagctggatgggccagtagtggagggaggaaacggcagcctctgcctgggccttgccctgggtaaacagacctctctctccccagacagccactgtttgacgactgtctgccatgggcctggctgagcctgggccgccaaactgccaacgcctctgtattctctgggacaagcagtggaggcagccatacctccagcagagtttgtgaaggagcaggtcagaaagttgtcaaaacaggcatgacgaagggcagaggaggtggggagacagggagagagcaggcggccctgccctgggcagagccagagaaactggagggaggcctgggtgctcccctgggcagcttcccaggcaaacccagctgcctgcagggctcagcgctgggagcaggttgtggtcccagctctagccctgacacacacaggatctcaggtacttgacatttgtaggccttagcttccttacttgtaagttagaggctatgggcagattagtggctttcaaacaattttttttgttgttgctttttgtttttgagacggagtctcaatcttgtcgccgaggctggaatgcaatggttcgatctgggctcactgcaatctccgcctcccaggttcaagtaattctcctgcctcagcctctggagtagctgggattacaggcgcgtgccactactgcccagctaatttttgtatttttagtagagacggggtttcgccatgttggccaggctggtcttgaacacagcaagattctgtctctacaaaaaatacaaaaattagaggctgggcccggtggctcacacctgtaatcccagcactttgggaggtggaggtgggcagatcacttgaggtcaggaattcgagatcagcttggccaacagtgggaaatcccatctctactaaaaatgcaaaaattagccaggcatgctggagcacgcctgtaatcccagctacttaggaggctggggcaggagaatctcttgaacccaggaggtggagattgccgtgagccaagatcgccactgcactccagcctgggcgacagagcaagaccctgtcaaaaaaataaattaaagaaaatcccaactttcacctcctttaaaaaaagtgaaggtctagcaacactgatacctatgagacaacagtctcctggagccactttagattctcatgcttcctctaatttgccgtagtccccactattccttagtgtccccatacggaaacttattaatgaacataaatcaccatgtttgctgtattgtttttcttagaggaacgtgtgaactttgctcacaccctatctgttccatttatttcagttacttctctgggtattgagggcacttgagtgtgggacccctgatcactgagaccaaagcagagttcatttatttgcacgagcaatcttctatttcatagatttaccatgtttttaagtgactacaagaaaagtttaaattatgtctgtggctcacattctatttctattggccagcactggccgggtccctcagattctatagcagtgtacgtgtgcttgctgctaactcattctgcctccattttccattcttgcgtagaccaatcccagtcaaatctcttgggctggtgtcttctccccaccccacagttatctttggtgcctccaccctggttagctggccacctgtctgtccagaggatccaggctccagaactccaggcatgtcttctagaattctccacatgggaaatctcactcccaggccccatctggcagccattgtgttttctttatcagacattcacataaaacaatagtcaatttgaaagctaaatacacatccattcttctgtctccagcctgtaaatttaccccaaatccagtaatttgggaggtggagttggtgggaagaggtttttttttccccctcttctccagggcaagtcatatagtttttctggagatgaggtggactgagtttgggggaagaacacaggtccatctacagtgaaagcgctgactttgtttttggagaagatggtgtcatggcttctctggggagatgagatgagggaatcctgaagacttagggggccgggaggaaaaggaatcttggcaatgatgaagacaccttcaaatgaaggggctaatagggtagtggctgagaatttgtgctgcagtcgggagggcttgggttagagctacatccacagtatgaccttggacaggtgactttatctctctgatcctcagtctcctcatctgtaaaataaggataagaatagacttgacttccacttcaacgagaagtgaaacgagatatcctaccactgcgctttgcacataaaggctctataaatgtcagctgtcatcataaagagccaaaagtggcatttggagtaaatctgatttgtttttaagagatagggttttgctgtgtcacccgggctggagtgcagtggcatagtcaaaacccactacagcctcaaattcctgggctcaagccatcctctcgcctaagcctcacaagtagctgggactacagacacacaccaccatgcctgtctaacgtttactttttaatttttttaagttttaaaattttctgtagagatggggtcttactgtgttgcccaggctggtctcaaactcctagcctgaaatgatccttccaactcagcctcccaaagcactgggattacaggtgttagccaccacacccagcctagtttaattcttttttaatcatccttctctgcatttttgtaattcctctaccatgaacctgctttagttaagtaagaaacagttaactgggggaggagaaataaaaccaaacccctaaaaagcccctaataaacccctaaacgtggggtccaacatgaggtgttatggctgggaaaaggtaagagatcaaactatacacacccttttttttttaaattaaactttttagttttttcagagacagtcttgctccattgcccaggctagaataatggcatgatctcggctcactgcaacctccgcctcctgggttcaagcaattctcctgcctcagcctcctgagtagctggaactacaggcacgcaccaccatgcctggcttctttttgtatttttagtagaggtggggtttcaccatgttggccagcctgatctcgaactcctgacctctggtgatccacctacctcagcctcccaaactgctgggattacaggtgtgagccactgcaccaggccttaattaaacttttattttagattcagggggtacatgtacaggtttgttacatgggtatattgtgtgacactgaagtttaggctatgattgagctcatcacccaagtagtgagcatagtacccaacagagagttttttagcccttgcccttcctctagaagtccgcagcgtctattgttcctctcttgatgtcaacgtgtacccaatgtttagcttccttttacaagtgagaacatgcagtatttgtttttttgtttctgtgttgattcacttaggatgaggtcctccagctccattcctggtgtggcaaaggacacgactttgttcccttttttatttttttgacactgtccttgaacttggttgaggttttgttcccttttatggctgcatactattccatagtgtatatgtaccacattttcattatccattccactgctgatgggcacttaggttgattccatgtctttctactgttttgttttgtttgagatggagtctcactctgtcacccaggctggagtgcagtggcgcaatctcagctcactgcaacctctgcctcccaggttcaagccattctcctgtctcagcctcccaagtagctgggattacaggcatgtgccaccatgcctggctaatttttgtatttttagtagagacacagttttaccatgttagccaggttggtctcgaactcctgacctcaggtgatccgcccgcctcggcctcccaaagtgctaggattacaggcgtgagccactgtgcttggctgatgtctttctattgtgaatagtgctgtgtagaacatataagtgcatgtgtctttttggtagaagaattcattttcctttggttatataccaaatcatgaaattgctaaattgaatggtggttctgttttaagttctttgagaaatctccaaatagctttccacagtggctgaactaatttatattcccaccaacagtgtataagtgttcccttttttccacagccttgccaacatctgttatttttttgactttttaatgacagccattcttcagatatcaagggtggggacaaaaaaagaaacttaataatcattttgactagtgtgagatggtatctcacgatttcatttgcatttctctgatgattagtgatgttgaacattttttcatctttgttggccgcttgtacatcttcttttgagaagtgtctgttcatgtgctctatccactttttgttggggttctttgttttttgcttgttgaattgtttaagttccttgtaggttctagctccttgtagaattgctaagttccttgtagacctttgttggattcagagttcgcaaatattttctcccattctgtaggttgcctgtttactctgttgatagtttcttttgctgtgtagaggctctttagtttaattaggtgtcacttgtcaatttttggttttgttgcgattgctttggaggatttagtcataaattttttgccagggaaatgtttttgttttttttttttgagacagggtcttgctctgtcacccagggtgttaataacttaacaaactgagaccccaagaggaaaggtgattcggccaaagtcatacagtaagttagtggcagagccaagactagaatggtggactgtgggtgttggaagggaactttgaggttgttagggcagcctttcctaaggcgaggcccctcagacaagaaggattctattgttagatgtttgaaaactgctgaattaaagaaagctgcacaaatttcattatccgagaacttctcagaattcttaacacatgacaataccttggccactccaagaaatgcctgcagtgtatagggccctgaattagtttcaagagtcccttgaaggacattgacacctatgcaagctctccctgctctcagacagagaaatgctatatcttagatatactcctagttgcttttaaaaaataggattctagggccgggcatggtggctcatgcctgtaatcccagcactttgggaggttgaggcaggcggatcacgaggttaagagtttgagatcagcctgaccaacatgatgaaactctgtctctactaaaaatacaaaaaaaattagccgggcatggtaattagccgggcatggtggcatgcacctgtaatcctagctactcaggaggctgaggcaggagaattgcttcaacccgggaggcagaggttgcagtgagccgagatcatgccactgcactccagcctgggcaacagactgagactctgtctcaaagaaaaaaatatatatatagatttctagatttttatccacggttgcttgtcattgtgcaaattgttgtcattgtgcaaattgtatgatttttaaaattatactaccaaattgtctgtcgctggtatgtaggaagatggttgacttttttttataatctcatttctcctttttttaaagtaagaaatattacaaatatgcagagaagtatagagaataatattatgaacatttatgtatccacctctcaattttgtcaaatcttactacatgaccatgttttctttggatgttgtttgtttgtttgtttgttttaatgacaaattaaacattacacttagagttgaagccccttgtcttcctgatcccatcaccctgccacccttatcagtggtgatcatggtcaccatttggtatttatcatgtgtatttggtatttatctggtaatgtgtcattaccagacacattttcacagttctaccatacgtggctatataagcaaagtaaaatattttgcttatctggaaaatttatttaaatgatatactgtacatatcctgcagcaacttccttttattactcctcataataggtctctggatcttttcatgatgatacaagttgcaccagaccactcatttaaaatgctgtgtaggctgggtgcagtggctcacctgtaattccaacactttgggaggccgaggcaagtagatcacttaagcccaggagttcaagagccagcctgggcaacatggtgaaaccctgtctctatcaaaaaataaaataaaaaagaaataaaatagataaaatgctgtgtatccatgaagtactatacagtcataaaaaagaatgaaatcatgtcctctgcagcaacatggatatggctggaaaccattatccgaagcaaactaatgcagaaacagaaattcaaataacatatgttctcacctatacgtgggggctaaaccttgggtacacatggacataaagatgggaacaataggcactggagaaaccaaaggggttagagagggagggggcaaatgttgaaaaactacctattgggtaccatgctcattacctgggtgatgaattcattcatactggaaaccccagcatcatgcaatatacctttgtaacaaacctatacgtgtacctcctgattcgaaaataaaagttgaaataacgggccaggcaatgtttaaaaacacatgcagccgggcgcggtagctcatgcctgtaatccaagcactttgggaggccgaggcgggtggatcacttgagatcaggagttcgagacaagcctgggcaacatggtgaaaccctatctctattgaaaatataaaaattaaccaggcctggtggtgggcacctgtaatcccagccacttgggaggctgaggcatgagaatcgcttaaacctgggaggcaggtaaaaaaaacaaagttgaaataacaaaaaataaaataaaagtgtctgtaaatatcctgagtatatttattctgttttgtttatttgtttgttttgagatggagtctcactctgttactcaggctggagtgcagttgcacgatcttggctcactatctcagatgatgctccaaagactattcttatacctgtggatgagagtttctctaggtaacatgcagagatggaatttctgtatcttagacagtggatatcaacacttttaagagatgttgctaaattgctcattcttgaatgccaacttccacttccaacaatagttacagagttttggttgctctacaacctcatcagcacttgattttgtaagatactgaatgtaaaattatgcttcactttcaaatttacatttcctctattactagagaaggagaggctcttttgccatttgagcttcctacattatgagtgtgcttgtttgtatcctttgaccatttatctattgtattatttacctttccttatcaatttgtaggcattttttagcactcttagaaacatcttttatgcatgtatttttttttttttttgaaacagagtcttactctgtcgcccggctggagtgcagtggcgtgatctcggctcactacaacctccacctcccaggttcaagtgatttttctgcctcagcctcccgagtagctggggttacaggcatgcaccgccgcacccagctgatttttgtatttttagtagagacagggtttcactatgttgcccaggctggtcttgaacacctgaccaaaggtgatccatccacctcagcctcccaaagtgctgggattacaggtgtgagccaccacgcccagccgaccatttttaaacgtacagttcagagacattaaatatattcacattgtaatacaaccatcagcaccatccatcacctgaacttttttcatcttcccacactgaaactgtacccattagaaaatagctccccttgggaggctaacatggagaaacctcgtctctactaaaaatacaaaataaatactaaaaatacaaaaaaattagccgggcgtggtggtgcgtgcctgtaatcccaggtactcaggaggctgaggcaggagactcgcttgaacccgggaagtggaggttgcagtgagccgagatcgcaccactgcactccagcctgggccacagagagagaccccgtctcaaaaaaaaaaaaaaaagaaaagaaaagaaaagaaaatagttctcctttcttcccaggccctggcaaaccccttctactttctgtctctgtgaatttgactactttcctgtaggctagtggaatcatacagtatttgttctttgtgactagcttttcccctagcataatgccctcaggatccatccatgttgtagcatgtgtcagaatttccatcctttttaaggctgaataatattccattgtatgcatataccacattttattgatccattcatccattgattgacacttgggttgcctgtaccttttggctattatgaataatgctgctatgaacttgagtatacaaatctctcttccagatgctacttttggttcttttgggtatatactcgggagtacaattgctagatcatatgatagttctatttttcattttttaggaagccgccatactgcttgccacagaagctgcactattttacgttcccaccagcagtgataggaacgtaaaagggttacaatttctccacatcttcaccaacacttactattgtctgttttgttgttgttttataatatccatcctaatgggtgtgaggtggtctcttattgtgtgttttgtttgtttgtttgtcttggttttttttggagacatagtcttgctctgtcgcccaggctggagtgcagtagtgcagtctcagctcactgcaaacttctcctccagggttcaagcgattctcctgcttcagcctcccaggtagctgagattacaggcatgtgccatcacacccggataatttttcttttcctttttttttttttttttttttgagacagagtctcactgtgtggcacagactggggtgcagtggcgcgatcttggctcactgcaacctctgcctcccaggttcaagcgattctcctacctcagcctcctgagtagctgggattacagatgcatgccaccatgcccggctaatttttgtatttttagtagagatggggtttcaccatgctggccaggctggtcttgaactcctgacctcgtgatccgcccgccttggcctcccaaagtgctgggattacaggcgtgagccactgtgcctggcccacacccagataatttttatattgtttagtagatttgggattttgccatgttggccaggctggtctcaaactcctgacctcaagtgatccacttgccctggcctcccaaagtgctgggattacaggcatgagccactgtgcccagcctcttattgcagttttgatttgcacttccctaatgattagtgatgttaagtatctttttatgtgcttaatggttatttgtatatcttccttggagaaatgcctattcaagtcctttgccaatttttttgttttcttgagacaggtcttgctctgtcacccaggctagagtgcagcagcaggatcgtggctcaccacagcctcaaactccttgactcaagtggtcctcccacctcggcctcccaagtaagctgggactacaggtgtgcagcatgcctggctaatttttaaatttttctgtagagacaaagtttcactatgttgcccaggctggtcttaaactcctgagctcaagcaatcctcctgcctctgcctcacaaagtggtgagattacagacttgagccactacacctggcctctttgtccatttttaaagtttttggttgttgttattgagttgtaagagttctttatatatttcggacattaaccccttatcagatatatgattggcaaatattttctcccattctgtaagttgctttttcactcagtcaagtgtcctttggtgcacaaatttttctaattttgatgtagtccaatttatctaatttttaaaaatttcctgtgcttttggtgtcatatccaagaaatcatcaccaaatctaatatcatgaagcttttcccttatgttttattccaaaggttttatacttttccgtcaaactcatttttagttaattttcgtatatggtgtaaggaaagagtctgatttcattcttttgcatgtggatatacagtttcccaaacatgaatttggttttgatagtactttgttaattaagacttttgcacctggtagacgctctttgacctctaacccactggaatcctctcaccatccttccctgacagttgaccatttagcttgggcttaatacttccaatgacggaatactcactacttaataaagcagcttttcctgtggtagaacaattgtattttatagaaagatctccattttgagcctcaagtttcctccctgtagcatccacattttggtcctcgttcattctctgaagctgtaggaatcagtgagagctttttttttttttttttttgagacagagttttactctgtcacccaggctggagtgcagtggcacgatctctgctcactgcaacctccaactccagggttcaaatgattctcctgtctcactctcctgagtagctgggactacaggcacatgacaccacatctggcttatttttgtatttttagtagacggggtttcaccatgttggccacgtgaaactggtctcaaactcctggcttcaactgatctgcctgcctcagccccacaagtgctgagattacaggcgtgagccacttcacccagccagtgggcactcttttccaaaggaaagtactttgttgccttttttttgagactgagtctcaatctatcacccaggatggcgtgcagcggcacgatctcagctcattgcaacctctgcctcccaggttcaagtgattcttgtgcctcagcctcccaagtagctgggattacaggtgactgccaccacgcccggctaatttttgtgtttttagtagagacagggtttcaccatgttggtcaggctggtctggaactcctgacctcaagtgatccacccacctcagcctcccaaagtgctgggattacaggcctgagccaccgcacccggcaggaaagtactttgaattgagtaaataacgcaactatatgctgggcagctacctgccaggtttataaggtttaacacatttactccacaaagcaatctatgaaaaggtcctatcattgattcctattttatagatgaagcaaataaggcttgaagagcttatgattttagcaaggtccaacagctatgtaaatggcaccactgatatttcaaaggcaatggccctgaccactctgctacaccacctttctctcctcttctccaatacccagcccaaaactcttttggatctttgattattcttcaaggggcatagctttctttctttctttctttcttttttttttttgagacgaactctcgctctgctgccgggctagagtgcggtggcgagatctcggctcactgcaccctccgcctcccaggttcaagcaattctcctgcctcagcctcccaagtagctgggactacaggtgcgtaccactacgcaaggctaatttttgtatttttagtagagatggagtttcaccatgttggccaacatgatctcgatctcttgacctcgtgatccgcccgccttggcctcccaaagcgccaggattacaggcatgagccatgccgctgcactcggcctaaggggcatagctttctcatcctctgccatcctaggaaaattttaagtattcatattaaaatgaaaactaaacacaattgtccatatatgctccttaggagtagaatgccaaggacctcttagctcctctgacctgggaactacattctctctaatgatacatacgactgggttagaggtttgggcagctgccaccaagtaaaacctctagaattttgctatgtcactttctgctaaggtagcttttcccatctacactaaataaataaatcatccaggtgatttatttttaaccaatgcagaggattttttacttatctccatggagttcaaacatttctccaggctgggtggggtgactcacgtctgtaatcccaacactttgaagactaagaaggggcagattgcttgaacccaagagttccagaccagcctgggcaacatggtgaaatcccatatctacaaaatatagaaaaattagccaggggtggtggtccacacatgtagtcccagctactctggaggctgaggtaggaggatcatctgagcctggagacttggaggctgcagtgagctgtgatggcgccactgcactccagcctgagtgacagagaccctgtctcaaaaaaaacaaacaataattcaccaaatctatttggatctggatcctgccatcattttataggtaatgcctccatagcactcactaagtgccaggcacacttctaagccctttttatacattaacacaaataatccccaccacgacctaatgccatacacatcattatggtcactattttgcaaataagaaaacagtcacagagcagttcagtaacttgtccagggtcacacagctagtccatgactgaaccagaatttaagcccaggatgtcaagttccagaattggtacactcagcctcaatactgtgctgccttcaaatattctgacaatcttagacagctttggggatccaaaagattgagaagtactcttggggacctcttttttttttttttttttaaatacggagtctcaactctctcccccaggctggagtgcagtggtacaatctcagctcactgcaacctccgcctcctgggttcaagtgattctcctgcctcagcctcccaagaggctgggatattacaggcacatgccatcatgcccagctaatttttgcattttaagtagagacaggatatcaccatgttggctagggtggtcttgaactcctgacctcaagtgatctgcccacctcagccccccaaactgctgggattacaggcatgagccaccgcacctggctcccattttttttttaagacggagtttcactcttgttgcccaggctggagtgcaatggagcgatctcggctcactgcaacctccgcctcccaggttcaagcaattctcctgtctcagcctcctgagtagctgggattacaggcacatgccaccacacccggctaatttttgtatttttagtagagatggggtttcctcatattggtcaggctggtctcgaactcctgacctcaggtgatcttcccacctcggcctcccaaattcctgggattacaggtgtgagccatcacgcctggcccctggctccttttttttttttttttttttttttttaaataaagaccaaaggtccagaggctttgaaaggcaaatagtattaagtcaggatttgatatcaggatttctttcattctgtttattttctcattgctttctacttatgatactgtttcatttggtagtaataatatttctttctaaaataaattgaagtaaaaagaagtgagttgatgtaagaaaaatgttacagatatgaaaaaatcataatggtcattaaaaaattagtgaaactttggaaagactgtgttcagtcaagtgaagtgaagttagcttgcaaccacaaaaaaacccctaagtctcaatggtttgaacagcaaagttaattgctcacctatagtacacgcccagcatgggtcggcagggggcgctccgcgttgtggaacgattcatatctatacttgcttccccaacaagggcagcactggcctttaaagcttctgcccaggtgtgacacaggttgtttctgctcacatctcgttacctgaaacaagtaacatggtcacatctcatttcaaaggaagcaagaaaatgtaatccccatcatgtgccggaaaggagagaaatagaatagttgagaacagccctcagagagactataagtaagggggcataaaagatgggtctagagagataggctgagtcatgactcactgaatttgtctgacgtagatcatgatggcccatcccaccaagtggccaacatttgttcccagaaaagggagtgtgatgatcccccagaaagaacacagtctgacaacattattctgatgagcagacacacctctcaggctgccactcaggagtccttttgggtggggaggtggggatgctgatatttcctaagtggtttcagctgaactctgtgatcttttttttttttttttttttttttttttgcctattccctgaagggagatgaggcaatttgggctttggctgagctagggtttggttctgtcaccacttgctatctagggaagggtaataattggaaaggagaggaattcaaggagagggtccaggtgggtagggagcctcacacagggtttggtgatcaggtgattgagaggcctccttgaggagttttcaaagtgcggtctgagggcacctggtatcagaagtgcccagaagctcattaaacacttgggccaggtgctccatggctcctgcctttaatcccagcactttgggaggctgatttgcttgaggctggggttcaagacaagcctggacaacatagcaagacacctccccccgtctctattttttaattaattaatttgtttgtttattaatttatggactctcactctgtcgcccaggctggagtgtagtggcctgatctcttctcactgcaacctccgcctcccaggttcaagcaattctcctgccccagcctcccaagtagctgaaattacaggcatgcaccaccacacccagctagtttttgtacttttagtagagacaaggtttcaccatgttggccaggctggtcttgaattcttagtctccagtgatccacctgccttggcctcccaaagtgttgggattacaggcatgagccaccatgccccacctctatttattaaatattttcttttttttaatctgatgactaggcccactgttggtcctggcacctggaggtaggaccccaggcatctgattttttttgttgttttttttaaggcagggtctcgctctggcgcccaggctggagtgcagtggcacgatcttcactcactggaacctccacctcccaggttcaagcgattctcctgcttcagcctcccgagtagctgggattacaggcatgcaccatcacgcctggctaattttttttttaatagagacagggtttcaccatgttggccaggctggtcttgaactcctgaactcaggtgatccacccacctcccaaagtgctgggattacaggcgtgagccaccgtgcccagccaccatctgatttttttttttttttttttttttttgagacagagttttgctcttgttaaccaggctggagtgcaatggcacgatcccggctcaccacaacctctgcctcatgggtttaagtgattttcctgtctcagcctcccaagtagctgggattacaggcatgtgctaccacgctcggctaattttgtatttttagtagagacgaggtctcaccatgtttggcaggctggtctcgaactcctgaactcaagtggtccacctgcctcagcctcccgaagtgctgggattacaggtgtaagccacctcgcccagctgccatctgaatttttaataatggccccagatgattcttatggacaccaagatttgagaagcattgaatgactgagagaaaatttcttgtaagggtagaagcccagcacagtggttctcagtggagataatttcaacccccaagggacatttataaatgtctggagatagttttgattatcacaccttgagggtagggaaaagtgctgctgacatctagtggctagaggccagacatgctgccagggacaatgtacaggacagtccccacgacaaagaattctctagcccaaatgtcattagtgcttaggtcaagaaaccctggttagccattaagagtttgaacctttctaaatgttggagcacatacgatttttaaatcttcaatttttattttattttccaaaatttctactatatgcatagaatccttttcattgaatacctgttacgcaccgagcacttgaagtttacatcactatcagttcctcttgaaagaccttttcagtcattcatccaacaactatccattaaacacttactaaaatgtattccaggccaggtgtggtggctcatgcctgtaatcccagcactctgggaggccgaggtgggtggatcacctgaggtcaggagtttgagatcagcctggccaacatggcgaaaccccgtctctactaaaaattaaaaaattagctgggtgtggatcccagctactcaggaggctgaggcaggagaattgcttgaacctgggaggcggaggttgcagcaagccgagatcgtgccattgctctccagcctgagtgacaagagcgaaacttcatcttaaaaaaaaaaaaaaaaaaaaaaaaagaagtattccaggcagaggggaaagtatatgcaaaggcccccaagacaggaaagaaaaactttaaaatggctagtatgcctgctgctgataggggtgggggcaagtggaatgaaatgaggttggacacggagggatataaaaacaagggcgtgcatggcctcacagtgttaagtgggagttgtatgagttttgttataaatgcataggaagtcataaaaatttaagtagaagaggatctgagccaatgtacatttgtacaagatcacccttggcccctgagtgaagagtagggggtagggaagccacaggagaaaaagtgaaggggtggggtggaggcaggcggggggggggggaggcggggggggcggtggagcgggggagatcccctccccaaccctggcaggtttaaaaaaaaaaaaagggaagaagtgaaaagacttttgcagacctccagagatgatgcataaggttggctggggtggagatggaaagatggaaaatctagattctgtttggagggtggcaagaactggattttctgatgaactggaaggcatgagaaacacaacacaaagattgtgacttgcaagatgttggcttgaataattgagagaaggtgggtgatgatatatgacatgtagatatgactatcattctcttttgacgactgaggaaggggaggtgagtcgtcctacttcacaaagatagtatatgggctccaggtgtgtctaacccaaaggttataatttttccacactcctatatccacacattaatttttttttttaaattgagacagagtctcactctatcacccaggctggagtgcagtggcgccatcgtggctcactgcagcctccaactcctgggatccagcgatcctcccaccttggccacctaaagctggagttacaggcatgcaccatcacgccctgcctatcttaattttcataatgggtatgacatttactgatagtaatatcattatacatgccccatacatgctaacatctgcttccacatggaagcagcacaaagcctggaaccttcctcaaagaccccccccacccccgtacattggaacaaggtgctgggaacagaagtttagtaggtggtggaagggcagcggctgctaccctgggaactggttttaaaatcttacgttctgattgctgccgtggccatgtgctggtgtgtgatggggagatgttcttttaggtaactaaatccaacgagctgtgattggtgatcgaaccgagcaggcctcctctggatttggagagacatagtgcgtctgggcctgtgattggcgggattgctgtgattggtgaagtccctaaggctatctaagtttctgaacaccagttcctgcgttggccacgaggaggagcccaggaagcgcaaagcgcagcactgcggagagtcttggccgcctcctccgggacgccctccggcccagcgcggtgcctgccctgccctgcgccctggggcaaccgcgggatgaggtggggcggcaaagggtgtcagggctcccagctgcggcccgggtggccacgcttctctgcacagttcctttggcctcttcccctggctcccagccccacagaagacattggctgacccgaggggtggggctgcgggttcgcgaaggtttgtgaaggcccagatccaagttgcaaaactgtggagtctatcaagtgagacttagcagccccactccctcaggtgcgccccttgccctcctcagagtccttctctcaagtttagcagcctccaccgtgccctttaagatcctcaaagaacttttgcaaagtggcatctcattggagctaaaatgacctgtgcaggcaaaggccactagctcaggggatcgtcctgcccatccccaggtgctatcacatcgcgctgtgcgtcttcactgcacttaaccactgtttgtaattgacttcgtttttcatgtatttacttgcttatgtctgcaacccgcctctccaccaaaacgcaagctctgtgagggagggtgtagggttgcccgacacaacacaggacacccagtttcatatgagtgtcagatgaacaccacagtttaaaagtataagcaggtcccatgcattatttgggacacgctcatactaacgaagtatttcttgtgtatcttaaattcacatttgactgggcatcctgtatttttatttgctcatctgcacccctctgagggggatattttgcccatggtcttccctgctgcatctccaccacccacaacgatgcacgcagaaggtgctgaataaatgttgactgtttcgatggacgatttccatcctttattcactcagttattcatccagcctatttatatcaagtgggtcctgggaatacaatggtagatgggacacagtccagtggaggaggcacacaaccagtctaattaccatctgactaaacgatgatgatgtaaagctttgggggctatggggggacagaggaggaccccggcgttctgtttcccggaggaagatgactaagatgggacttggaggatgagaaggcaaagaaggaagtgcgacagctctctgcttgagaccacggggttctggaagctgcagggggctggggagggcaaatgtgcagtgtgggcgtggcagtcaggaaaaggtgagaaggagactcacattcactggatgttactacccaccagccagcacaagagggatgccatgttgctattattgtgcccatcatacagatgaggaagctgaggctcagagaagtgaaatgcctcggctaagtttacagtcgtggagggaaaagctgagcttcaagctcaggtctggcagactctgaagcctgcactcttctagaaaagccactgggttaaggattacaatgccaatagggggatggagaaacacgctcagaaaggtgatagggctctccctgtgaatatggctctgtccagttgagcagaatactgaagcaatgcaagagttatggttttttccaagccctccagagagacaacaggagggccagagcaggacccaggagtccagaccactgtgtctcccattcctattggggttggctctctaggagccccttgcagagccctggggctaattccttgcatggatcctggacaggtctgcagtttccatggagaccgcctcccaccatccctgaaatctcattgtgaccagtattaagggattaactctgcccagcggccctcgcagggtctggggtgctgagaggggccagcaggagctccctcaaggatgaagaggttgtgcactgtgcgggaccccatagcagcaggaggaggatgtcggactggggccagggcttcccccaggacccaccaggtatggtcctgactccacatctgcctggaaggaaggatgggatggtaggagagagacacagaaccaagggggaggattccagactgggagcagtgtggaggatttgtaccctcatcccctaacccaggaacgtccatggccctgatgggtgaatgacgttccaatcagagaaggagaatccagacgacctcaacaaggtgagaggagccccgtagagtattaggggtagtccaaggctgcctaaagaccagatctcttatctctctcattttgcagttggggaaactgaggcacggagagggaaaatgacttgcccaaagccagtgagtcagcaaactgaagcaggtcaagaatccagagggaaccctgaagttccctgagcagaaaacaatcggttaaaatctcattgccacttctgccttgaactccaaatcctccttcctgagctccaggcatggggtcccctccatcccctcacccagagcttgtctcatcggccatgcttccctccctgcctctcatcctcctcctgacttcccctgccacccgcaccacctgaggctggcagagagttcctggcaggttctccagtgctgacgggcacagccaccaggcccccactattccatccaggggacaccttcccactgggtccctatctggatgacttgggacattctttgttctacacttcatcctctctttgggatttctgagtccagacacagtgaggaccccgacagcccccctcctcacctcttgtcctgggaaggccaggcctgcatggcagagatgtaaccagactccaaagctttctgggccgggcttcatggaaggccgtatcggtgcaggggcataaacacaagctctggagccaggtagagatagttctaacaccattgccttggctcactgggaaaatgatgtttcttctctgagcctcagtttcctcacctgtgatgggagacgagaacccttccatcctcaaagcttgctctcagctgctatggaagcatctccaggttgtgatattaaatgaaccaaacaagatacagaacagtgtaagagcagaggctactcatgtatgatcttacatgctatctggtctgtataaagaaaccttggcagatacatctgtaagggatgtggttccccatagtgaggaagtcaaggagaacaggtgaacaggagacagctggaagcaagacttctcaatttacaccttttatgttttgattctgaaccatgcgaatgtagcaccaattcaaaactaaatgtaaagatgttcacaaattaagtaaaatattaaataataataataacacatacctcaataatatgaccggtgtgcagtcaagatttaggcccaggtactagaaattgactcaaagcaacagaggaggcctgtcttcaagtcaccgaatccttgacctagaaaggccctttattttgtcaacgtcaaattgcccataacaacaataatagtcttggtagcaagaatcaggagctccctacttggggaacatggtgccaagcactgtctgaacattatctcatttaattggcattttgattttgtgaggaaacgatcatcattccctctttacagatgggaaaactgagcctcgctgaggttttgactagtaagttgtagtaagtgatagaacttgatgccatcgaaggctttccaggttcaaatttgaagcccccctacagtgggtctcaatattggctgcacaaaaatatagacgcctggcacctccccacccctaccccaagattcgatcattgatctgtgatagggactgggcatctgtctttaattttaaaaaatctttttaaaaaatagacatagggtctcactatgttgcccaggctggtctcaaactcctgggttcaagtaaacctcccatctcagcctcccaaagtgctaggattataggtgtaagccaccatgttcggccaacatctgtatattttaaaggtttcagatgattctatttcatcttcagagatgagtctctgctttgttagacaaaacttctccaatgggaaaccaaggccagggagggaaatgaccttgcccaaggacacacagtggctggaaccagagctggggcaggacacccagcagcttacatgaagccctagggcaaataagaaaaaggcaccccactctgggcaggcagagctccatgggcacttcgcttggcaagtggaacaagggctgggtttccatccctacctgccctcttggctggagaacctttgtgcagtgagcaacctgcacaactgtacagggcagtaactctgatctgagcctcaggacttccaaacacttcaccttagtgacctggcaaatccctggggcccctcagaacaagagtatggggagaccaagggtggcttctgggatgtgggctcagccctcactccccaaaccagagtctgggtcaggcaggggctcccatcagccttcaggccccacaagggccgggaaggccgcatctaattcccaaggtcacccctgcagataaattcaggaacataaacaggagggatgaacataaacaggaggacagcaacaccctcagcccagatgtcataagccacctggcaggaggcagcctgcggagaagctccacccacacagatccaagtcctcctggcttccttcctgatcattctccagaccatactctctgccctacctccggagccttacagtcagcatctcccacagtgccctgctctctgcccttctcctggccatctctcactggcatccctggaagggaagggtagccctggagttagaggcacagactctagagacagactgcccaagttccaattccacttcttgtttctcatcagctgtgtgagcatgggtatatggctcaacctccctgtgcctctggtgtgtaaaaaattggtgaaaacattgcctacctcccagagtggctgggaggatcaaggaagtaacacatgcaaagctcctaaaacagctgcatatccagtggccatgatgatcaatgtgtatattttgcttcatttcattttcatgacaaccctggaagttaagtattataattcccaatttacaggtgaagaaactgaggctcagagaggtggagagagtcagggcagggctctacatctttttttgtgatagggactgggcatctgtctttaattttaaaaaatctttttaaaaaatagacacagggtctcactatgttgcccaggctggtctcaaactcttgggctcaagtaatcctcccatctcagcctcccaaagtgctgatgcctccagagacaggacgtggctgagatggattataacgtagtctccggtttgcagtgcctggctgctggtcatatcctcacagggcccatgggacacagagccaggtgcattcccctgacttgggtcttccaatggctctcaggcacctctctgcttccagccagccctgggaggagggggagaacggcatggcaaggcgtttgcagagccgtcttgttcaccaatgtctttcaagacattgcccgggtccacagagagcccaccattcattcccatgctggctggagcccctgaatacccgaggtgaccttctgtccttggacaagtcacttccccctctgatctccatctccccatctgtgcaatgaggggatggggctgaatcagtggttttccaaccctcaaataaaatattaagactacatgtaaaagggagtcgctggttgaagctgggcctgtggatgcatacccttggctcctgggagcctcggaacccagcttgaaaaaccccagcccacatcctcctaaagattctcctggctctgacactgcagagttctagaaccccaagctcaaagctgccgcttcccatccctgtttggaaagctctcccccagctgcctttatctctctttggtaacagagcaaatttgctcaggacccagcacagggggaacaagcagactgttgactcttgagcaaagcctcttctttggagagcagccgaggtggccgtgggctatgcgttgggaggccagcggcctcttgcataaccctggaggcctcctgcccacccaggccttttcagggttaggggtgaggaaaaccgcaaactcatgcccagttaattttttaaggcaaaatcaacaggctcagcaatgattagcagctgggtaagttggtcttaatcaggctaaggacagggagggaggaaggaggcccagggatggggcccagttatcagttaaccacatgaatgttgcttccttccaaacccactggccttcagccccaagctccctcatcttcctctcggaaatactcctgtgacaagccagtggccacccatcatcgggtgaacaagccagtggccacccatcatcgggtgaacaaacacaatgccactcatggtctgtgatgaagtagaaagtgctcgttgttaagacaaagctcacccaccaccgctgcgtggacttgagcaagtccctttcaccctctgaggctccgtgaggggccccaggtctgggccccaagtctatggttcagtctgtggccagctgccactcccctgacggcctcagtgtttccgtccactaaatgggtgggttagccaaggcatcttttccagtcttgaagctttgtgggtgcctgatttgattaagccacagtggcctttgccgagtgcagagggtggtatgagtggcattttaggagctcaaggaagagaaagggaggggacctacctggtatctgccgttggtatcagcaagtgtcagatcccagctccaggaagagggctgtcctctcagatgggaggcaggggtccagtggggtggctgtggctgcagggacagcctagcagagcctcttggtggcccagaccccctgtccctggaccttggaagccgctaaaggaagcagcaagaccaggccagctggtggctgcctggactggagtttggtcagtggttggggacctatattgtgagatagttaggactttgtccacaaactggaatttgaaatttcaaaggggcaaaactgaagggccctaccccagagtagagatggctcttggcttctttcctccacgacttttgttctttgtcttgataagtcccagttttctctgcacctctcccggagtggtgggtggggaagaaaagataggagataatggtgtggtgagcgccaaggggaagtgaagatgccaagcagccctggggtggccaggcgtgtggaggatgcccctgcccctgcctataccccgggataaggtgctttacttctcaggtccttgagttcccctgcaagactgaggcagtgaaaccaccagctccagtgccttagaattccgaagtcctttcagggattccaggagtcatgatgcaggcaatgcgtagaggggtgaagccctcaagctctggaggcagactcgggttcaaacaacagcccctcccttacgagctgtgtggctttgggcaagtcacttcacctctctgagcctcaatttcatcatctttaaaatggggatgacaatagcccctatctcaacaggcagataatatgagaaggctagaaggtttttagcaccagggctagcacaaaatttctctgtaaacattagaccttattataatgtaaaagagaaacaatgtggttcgtagtggcagctcccttaccaccgtccacagcagaggcacaagctccctacacatgcctccccaactgcaggttgcccagggcaatcccttcccgtctcaactgggtctctctgtgggctctgaggtcctctgctatcccctggaatctgctgcctcttgagctggggcccgacagcaagtgagcagaggtaaagaacagctgctaaattgatggcattgaggctagtgcttgttcatggctgggtgtgtggtacctggagctgtcctgagcaggggtcctgattccaactgattatgtggccagtgtgtcatgcaatcaatgaccaatgacagtgattgctactattgtactgtatgcctacacgtggtcatttaatgcttgaaccatccctacaaagaaggtatcaacccaatttttctgatgcttaaactaaggctgagaaaagtagaagttgaggtcacagagtttggtacattggcactgcctggattttaacctagatctatctgacccacaaggtctgtggtttattcccctaaagagaggtcaggggaagagaggctaagaagcttatctactctctcatttaatcttcacgacaaacgacaagttagaccccttgtacagaaggagtaaccaaggcttcgaaataaaaacttgccttgtgcagacagctggccctgggcttggaatataaatagtcactggtatacaggcaccagagaccaatacccacaggctaacacccactcagtccacagaaagaagcttaatattttttataagcatagaaataaaaaccaaaccaatactgtgacatttgctctgtgacttcctgtatttattatgtgctcatatgaaagcacctaagcattgtcaggataatgttcttcctcactggagggcgttatgaagttgctttcttttttccactagttaaaaaaaaaatcccttggaggaagggaatgaaactttttataattgatacataataattgtacatatatatggagcacatgtattttgatacatgcataccatgcaaagtatttaggatatccatcacctcaaacatttatcatttctttgtgttgggtacatttcagatcttctcttctggctattttgaaatataaagtaaatgattgttaactataatcgctctactgtgctataagaactagatcttattccttctatctcacttatttttgtacccatgaaccaacgtctcttcatcccctgaagaaaacattctttttttttttttagacagagtcttgctctgtcacccaggtgcagtggaacaatctcggctcactgcagcttccacctcccaggttcaagtgattctcctgcctcagcctcccaagtagcctggactgcaggggcatgccaccatgcctagctaatttttgatttttgtatttttagtagagacagggtttctccatgttggccaggctggtcttgaactcctgacctcaggtgatctgcctgcctcggcctcccaagatgctaggattacaggtgtgagcccctgtgcctggcctgaaactttcaaggtctcaagacactgtacatttaaagtaccccaatgttttccttttccacctcccgttctttctccttatctaacatgaagaacattgtattaaatctgatttttaaggagtttttgtctgttatgtgttaagggtttgtttggtaccccaatgaaaacattctgcattgcagaccaaagtgtgcttatttcaggggcatgggatcattgcgttcttagccattgtcacaaaatacatggagtcatatttaaaatgtaaagttgtaacatacatatgtttaaaatggaaatacaaagcaaaaagatggatgtacaatgtcatgtgtattcagttctctgtacttagtaaatgtaacaaactttctgtctattactgaactataggtgcaaggacacgtctccagttactttgcatctgtaatccacaaagattctgggcagctgtattatcatagcttggtttaaataaactatgtagtaacaatgaacaacaagaacaaaagaaataatagcttgcctgaggtcacagagccagcagatcttataggtggtgcgtcatttatatgaggaatgtgtatctaggagatactgtttggcgttggctaagggtggaatgaatcatgtatgtaatagattatgcaatttacagtgatgagtggatagatttacttatggggtaggttataatgtggtgggatgtgaatctagaatgtgcctcctaggcagtcatgcagattgtgcatttggtaagtcaggtatgtcatgattcatgtatctaatagctcttcatttgcagtgtccacctagtagctcttggatataacgggtcatggctgtggcatggtgtggttgatcttggttgatcgtagaccttatttaattgaatctaagatgtcatctatggaaaaatgcattgttatttttgttgccaatgaaattctgacatgacattgatcacattccccgttaagcaatgtggaactgtgcctcagagtggaagaggccatgtattcctggattgtgtggggagtagctgtgcctgtggcctgccataggtgccaggcaggtggcagaggcctgggctcagcccttggaggctcctcccggagctgccctccacatctcttctgtgtttaccccttggtcggatcttctgtttcttcccacctctgcactgcccccaaggccggtggagccaggtcagatactcctgaggtaggcatgggaggaacccgccggtatttggtctctttcagccccttatcaagtctcatagtgtgggttgcagggggctgcctcttgctccctccctcagagtcttgtcctggctaacagaaaactgagccaggatcatctttctattttacagagggagaaattgaagccctgagaagagacgatgtaaataaagttatcggaatagtgactgagctagttcctaaccccaggtctcctgacatcaaatctagcctctcttgtcctccacaacagttgctccctctcccctttccctacaggcaatagcactccccagtcatctcagcttcagaggtcagatcaagtggacagaataaagctaagcagggcagagaaagggcttctagcagtggaaagaacatgaagatgcctcctcataccactcgaacacacatgccctgactcccgatttgctcactcattaatccacccacacattcactcattcactcactcattaattcacccacccattcactcattaattcacccacccatttgctcacttactcagtaatttaccctcattcgttcattcactcactcattcatgcattcactcaactcactcattaattctccctgtctctaattcactcactcctaattcacccactcatcaattcccccacacactcactcattaattggtgctcccactaattcgcccactcttgctcacaggtgtcaccgaggccctccaacctgcccttccagccagcagtggaggacaggctcccaggcctcccaagtctcaggcttttcttcctctgccctcactctctgccttctacatcaagactttacttccccagattgattggcagcccttgaaaatgtctgcacagaaggcaatgagggctggagggagtgagaagaacagagtgcaccatgagcttcagacagccaggaccagctgtgtaattttcagggccccgtccaaaacaaaaatgcacaatcccttgttcaaaagtcatgatgaattttaggacaaccacagcagagcactgaaccaggaaccaggactttctaagggttgggttgcctgtgactgcactggcgatacccccacaaagcccactctgaaggtaggagacgggtggagagaaacagggggatggcaagggggatacgaaacagggagagggaggagggggaagaggatggacgtctaccaggccccacttggtgcttgatttatgccatctcatttccttctcaaaccaccctttgaagttgattgtacattttacagaaaaggaaactgaggctcggagaggagaatcatttacccaaggtcccagttagtagacggtaggtgcctgaatgtaaatccaggtctctgcctgctccgggagggggtgggggtgagggaaacaggagaatgtgatgggaaaatccgagatggagccagcctgggccagaaacactgggagctgtgggagacggagaggggcagggtgggatcacagggagcaggagcggggaattggaggtgaatctggccctcccaaacttccagtccattctgctcccaggggaaccgggaaactgcgggggaactggaagggagctcccagaacaaggatccagaagattggcatctggggcctgggatttaggtttctaaatcgtgggccatggggcagccttatctctgcaaaagcattgagggtagaagtcaatgatttgggaagttattgaattaggggatctcggaggtaggctgtcagtgcctgatagtatcagttagaatgcctgacttggggtgacaatggcttggaggggtgggtgagtcaagggtcaaatgagtgcccgtgagtcatgatgcctgccttgtacaattgataactgaacatcggtgagttagggccccagcagttgtaattagcaccccgggtgtcagccagaaaccaacaaacagccaaatccctgcagccccgcccagcctatccaccggcgggggaccgattaaccattaacccccacccctccccggcagagcctccaccccttcacagaggctaggccaagactcccagcagatcttcccagaggacggtttgaaaggaaggcagagagggcactgggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatggtaggtgggggcagatgtgcccaggtgtgccagtgggggcaggtgtgcctgggtccaggagcagatctttggcactcaactttggggtgggaggagaatgatacaaaatggtaggttggtcctacaggccagcacaggtgttgccaagtgaagcccatgtgcccaggcacagtgatcacaggcattctgggtgaagggaggcctgcaagggccaatttccagcaaaagtcgatcccggctattcctcccaggcccttccagtcctcactgcctcacagtggctctgcttggcgcttggcacagtgacgtgatggtgagctcccccttggtgcccagctccagcgattcagcccagcacggccccttcgtgaaccccttgggcctaggttcagagagacggcaagggatgttgtatccctggagatggtggttggagacataaccgcatttctcggtgtctttgggactttcctagggaaatgaaattggcacttagggaaaatggagctctcagggaagttttgctaactacgaagccaactcagcactgtgtgtgttgtgtgtgcgttcgtgtgtgatagtgagtttccatgtaggttgtatgggtggggtgatgccttcaggaacccatttgcatatgtgtgttcatttgtctctgtgtgtgagttctgggtctattttcctttgtattcattgagtgggtctgtgtttgtgtcttaggagttgcccgtgttgatcttgcttatgtatgtaagtgtgtatgtgtgtgtacttgtgtctgtggatgtttgtacatgtgtgctgtgtgtgcgggtcatagagcacatgcgtttgtgcatgcggacctgttggagtgccctgttcttcctgcatctttatcctgtatgggcgttttgtcgtgtgcccatatttgtacctgctgtgtatatatgcagttccctgtgctgcgggcgggggtcagcggtctctggtgtgcacgactgcacagacccaaatgcaggactctgttgttgccactcaccaagtgagattcatatcagcaacatgtccgtttgtctctgagcagattttgttgccgctgcgtctcgccagattgaggcatcccctccgacatcactggagcatatctggaggggtggacagttctccacagggaggtaggggaaaagaggaggcccggaaacccctcctggagggaagagccccatcggtcccaggccagcctcagaggagagggggcaggcagctggctgaggtcagcctgccaccctgcttccttctgtgtcttggagccactcagccagtatgaggctgcagctccagctgaggtctggaatcttgtggtcagctcagctagggtgaggaggcagctgctgggcactgcttgttgtcagctcagcaggtgctcacctgcccctgccgtccagtcacgtgtgaccttgggcatgtcacctcccctatcctggcttctgtatcttctacaaaacaggcttcattcccccaggcctgctggctggacggcttttaggcctgtctgaggaccacgccaggagcgcaaggcaaaaacacaccagagatagcaaacaagctgctgctgcactaggtggagtgttgtgtggccccacgaggaccactgccctgccctgggctgctccccgcccccatcactttttccaagcccaggaactgtgtgctcctgaggcagaggccaagcccctgaactgggagtcccaaagacaagaccacctccagctctggaaccagaaagatctgggctcaaatccggcatagatccttccaacctgtgtgaatgtggcaaggcaatttcctctctgagcctcagtttcctcacctataaaatgggaataaataatagtgtctgtctcccagggctggccagaggataaataagatgaggtgcctgggtgcttagccctggtaaagggcctggccccaccatgggtcatctcaagggctctgagcatctgtaagcagggtccccacattcctcactggagtttgaagtggtctgaattggggttatgtgaagttgtcctctgaagtgttttgagtacatcctgggctggtgtctgaaaggctccaaggatatttctcccccgtcctctccccaccccaatggagcagcagccctgggtggctccttgttcattagaggcccagcagacacctcaacatgtgtggcactggctggagtagcccagcaagcctggaccataaacccatggctctgcttcacgggaagcagtgcgatgacaccaggaagccacttttcctctctaagcctcagtgtcctcatctgtggaatagaggtgctcggctgacctcagaggggagatgatagagctgacagcccccagcccatcctgcctcagaggtgggagctacttccccagcctcctgctgaatggccaggagctgtgggggtcagctctccccgggggtcgggggaggagaggccgagggagaaagggcacccacgtggcttaacaattatccccatctccaggaataattcaccaagtggagggggctgcactcctggggacacctgggagtctgcgatggcagaaatgagatgcggcagtgtctgcttgtgcaaggagcctggaagtcctctgctccgagagttttcctatgtggaaaagtttttatttcatgaacactgatatagtgcttactatgtgccaagcacttcacatacacatatgagaattcaccgaatccccataacgaacctaggggaatatcacgttccccattttacaagtgaggaaacaaaagcatagagaagtaaacgaacacagtcaatgtcacacggctaaaaagtgggcaagctggaattgaaccctgggcagaaggacttcagaggctgtgctgttacctacagtgcatggccctctctgggtcttaactggatgcccctgaggaatccaaggttggattcaggatttctatgaatacacgtgtgtgtgtgtgtgtctgtgtatgtgtgtatgtttgtgcatgtgagcatgtgtgtgtggactgtgtgtatgtgtatgtatatgtgtggactgtatgtgtgcacacatttgtatatgtgtgtgttgatgtgtttgtatgtatgcatgtgtgtggactatgtgcaagtgtgtgcaatgtatgtggactgtgtgcatgtgtggactgtgtgtatgtgtgtgcatgtgtgtggagcgtgtgtgtgcttatgtgtggactctgtgttcatgtgtgtgtactgtatgtgtacacatgtgtgtatatatgtgtgtgtgtgcgtgtgtctgtgtggtgtgtggactgtgtggtgtgtgtgaactgtggtgtgtgtgtgcgtgactgtgtggtgtgtgtgcgcgtgtgtgtgactgcttggtgtgtgtgaactgtggtgtgtgtggtgtgtgtgtgcttgtgtgtggtgtgtgtgcgtgtgtgggaactgtgtggtgtgtgtggactgtggtgtgtaaggtgtgtgtgtgcttgtgtgtggtgtgtgcgtgtgtgtggactgtgtggtgcgtgtgtgtgcttgtgtgtggactgtgtggtgcgtgtgtgtggactgtgtggtgcgtgtgtgtgcttgtgcgtagcgtgtgtgcgtgtgtgtggactgtgtggcacacacgcttgcattttcccgggggctgacccattgcatttgtcatcttcttcaaaggggtctatctttgctgaaagatttgctgacaaataaagggggttcagctgctgctatttttttaaatttggaaacaaattttttaaattttttaaattttttaaatttggaaacagaccagtcaaactgctgccttttatggttagagaaaatgaggcccagaagaaattgaagcagggaaagcgaagttgcccaagtttacaggcgagttagtggcagcatcagcagtagtgcccaggactcctggcacccagcccaagatcctctttccacctgcctctacggcccccctcacatttgtgtagatgcagtagcttttgcctgtgggatgggagggatgggagatgtgtccagaccctcctaggaggccacatgagtgtgactgttctcggcccaagtctttctcgttcctcagagaatttgcggggcccctgggcacacaagctgagatccacccagccctggtcccttggcaagaactgagggacaggacctggttctggggaaaatgcaggggaatgtttctcccttccacagcccccttgcgagttaggaggccggctcccaccccagaaggtggccaggttttcatgccttcctagagaaagctggggctcgtggcctccaccacaggaagacgcagaccctcagaaacaagtctgtgaagtcacaaccagccccagtttacagatgtgaaactgaagctccaaaaagtcaggaggtcactgagtggggaggtgatggagtgggaacagcccccagatctggctgaggccgaagccctggagagatccccgcaaggctcccttagatgcctgacattctgttcttcctgaagcctcactcccttctctcctggcgcagacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcaggtgaggagcctcaatttcttcagctgggaaatgggcacacttgggctcatggccccaaggtctgtcttctccctgagtgggtaggtcccagagacagctgcccttcagggccttcaaggctcttctggttttgtaaaagactttgtgaatccaagaagagcatctattctaggaaccacatttactgatcatcaagctactggctgccgtttattgagctcttatcatatgccaggcacaatactaagtctttgtgtgtatttacccatccccttgagcccattgttgtttttcccattccatggggcctctcctgaagcctcagtagatgagcccgtcttccagtctggtgctgtttttgggacaaataggagattgaccccaggccgttccacctaccccaggggcttccaccaaccccaaagtcttcccaaggccttggagagccctctttcgaaagcatctcctgttctgggtaatgacaataataaaatcatagcagctgtcaattgcgagcacttgtcatgtacaaagactgtgccccatcggcgcatgacttcatttcacctgtcaacacccctgtgagatggttactgttgttattcccattttatagaggaggaagctgtggcttggagggctaggcatttgcccaaggtcaaccagcttgaatcactggcagagccagggttaacattcagggccccacccatcaccacggtgtggcactgcctctacttcctatccccctccagagagaggcttatgtgaaccgagtattaactctgagccataaccaggagcctgctatgggttctgagcttttataggatgtggtggaaatagcagggctctggtactccagaggtcaaggttcccaactcagctctaacaccaaccagcagagcgacccaggaccacatgttgcctctctgagcctcagttttcccatgtttagcaggacaggactgggctcttagagagttcatagcacctttccagctcctggtgggttcaagagagaactcccgggatgaagagatgagagcactgaggttggggggtcaactggatagccagggccctagttctgtcctaagaggaggaagttgtgtcttctccatccaaccatccaaagccctccccagatttagccggcagtgcgtggtggacaaagacaagaggaaccagtgccgctactgcaggctcaagaaatgcttccgggctggcatgaagaaggaaggtgagcctcggccctccccgccccaccaccactgccccacctgcacccacagctccccgacagtcatttacaactgtagccacactttatgactcagtggcaggccccagggtgactggctaatggctgagaagagggagggcctggaaatctgaccatagggagcggctgggcttggtcttgagaaagattcagagagataagctcccactcttggctcctcaggctcccagcaaccaccacccctgcctgcctgtctgcgccaccacaaagcagccacgttgtgtgtgtgtgtgtgtgtgtgtgtgtgtgtgtgtttaatataatatttcgaacgttaggacaagcatagagaatgatattgcaaacatctgagtactcactatcccaactttacaaaagggacagccagaggagcccgatgcctgagcttccggtcccagggacaaatgccccagttcccttagtattcattcgtgggtatcacgtgatctccaaagtcttcacattctagaaaatgggaacaagaccccagacccatcctggacaaaggaggagaagaccagagcacaacatttattaaggtcttgccaggcttcctgctaccagcaggtatcagtcactgggctgtgctttttccacacttcagtaggttgggttcatttcattttcatgacaaccctatatgggaaaatgttgtgaaaatgaaatgagcccagcccattgaacctattacaattcctccctttttgtggatgaaggaactgaggcccacaatggttaagcaacttgcctagggccccacaactgatccttggaagatctgaagtcccagagcttctgctatttggaccacacttcagcactgtctattattttatgctctccagataccagggacatttaaaattgttttcagcccaagcaagggaagcaaaaatcttttaactgctttaaagtaacttgaggccaggcgcagtgaatcaggcctgtaatcccagcactttgggaggccgaggcaggcaaatcatttgaggtcaagagttcgagaccatcctgaccaacatggtaaaaccccgtctctactaaaaatacaaaaaaattagctgggcgtggtggtgcatgcctgtagtcctagctactcggaaggctgaggcaggagaattgcttgaacccaagaggaggcggttgcagtgagctgagatcatgccactgcactccagactgggcaagacagcgagactctctcaaaaaaaataaaaaagtaacgagttcattttcgaatctcttcatttcctgctcctctaaactcaacctttcccagctctgcgactagtcccagaccttcccttctagcccacagttgtgccgtaccagccaaaccttggtctagtcctgctagttcggtacaaacacccctcacccccatcaccccagcacaccccagaagcaggaacgtaggacccagcttgctccagggcccactgagaaggaggggaggggaggctttggtagactctctttcccctgtatctgctcctggccccctgttttctctgccccctcccttggaaatatcttctatgtctcatccttatgggaccttagtctgggctcatgagctgtcttggaaaatctgggcttgctgatcccgatgcaggagtgggtggtccccaaggcctgctctgaacgctgcaattctaacatctagatatcagtggttctccaagggcaagaggggctttttaagctgcaaatactccctcctctcccaaacccagttttcaatggggttaagcctgtctcatccacttcaacttccattttgtggactgggaaagattatgaatgggaacctgatgcatgtgtgaacagttggaggcaagaaaaagattgagaactacagtctaaggttccaacatttctgtggttgtattagtcagtgattccattatcccaaaagcctaagattttaggcactatgattcctcataggtgtcatccagagggcactgtgtttgagagaacagctctctcacagtgaaagttcaggtctgtgacaggcagatgggagaggggttggcagccctcctgagtggatggctacccacctccactgcgtgtggcctggtcctgcgtgtggtcagttgttataaatgtcttttattagacatccagagtcattttcacttgtgtaatttagggacatttctgtctcttctgggctctagttttcccatctataaaatgaggacattggataatgaacccttcagccctatgagtctcgctcctcactccctgacctacctgcacaagtcacactgcccactaggatgggtgtgtttgttccctggtcccttcttttttttttttttttagatggaatttcgctcttgttgcccaggctggagtgcaatggcagtatctcggctcactgcaacctccacctcctgggtgtgagtgattctcctgcctcagcctcccaagtagctgggattacaggcatgtgccaccacacctggctaattttgtatttttagtagagacagggtttcaccatattggccaggctggtctggaacccctgacctcaggtgatccgcctcggcctcccaaagtgctgggattataggcatgagccactgcgcccggcccctggccctttcttgagctgctgcaaagccagcaaaccccttactaggctcctggaagggggatgagagccccagaccattcagccttagctcagccttgaaaatagctgcttgcttcctggcccagggaaacggacatgctgcccggaggataggagagttggctgatggcgagtgagcgtgggttagtcgatgctagtgtttgtttacatgcctgggttacctggaagatcatgacacatgcagtcacttggttgttttgagaacgggccagagtgacaaagtgttcagttgccactgtggtcaagccataggaaatgagggtattcctagctgtgcctgtcttctaggccccaccacccctcctcagcctgctgggaagctcccaaagccaaaagaaagtctcggtggaagtctcactggccaggagagttgggacaagtttttatttctttttcttgatgaccttaggagaatttgaggactgaaaccctaaaatagtccctgagaaccagaaagtgtgagctggaaaggtaggatttcaagaccagctgagtctataagaggtcatcaaatctacctgctccccactttacagaagaggacactgaggctagagaggtgatgtgacgggtcaggggtggagtcaggtctagaactcaggctccccagagctgagcagacaccaagctccctggagtgaaacttgcagtgatcagcttgggaggcacatttcttgatctagatggctgaaactttctctcgaccacagagaggggcttcaggtctcatgggcctataagtctctgccacaggatagtccaccatggctggaaggggctccctggaaggccaaagaatccagggagaaccctgggggtcagtgggccaacagcaggtcaagaattctttcctgcaaccgaaagccagggagacagacacctgccttggcctaagctgtcaggcccaggacaaatattcggctcctggcatcaaaaacccagcccagaaagcggacccagagttgcaggaggtgagcgtaggtgatgggccaggggccatctgaagaggccttcctcggaagcccctgccctgctccccacagccccctacccaggagttccctgggaagacaggctcatcacctctccgcctctgcccaggtcggttaatattcaatagaagttacattaggtccccgaccctgctaatactgagcaaacatttggaaaacatcattccgtgactgagctcgcgccgggcactgataacgcccgcctaaccttgaggagccctatccgcagctgctgacagcagccctttcattccgcccgccggccactcggcgccctgatgggtgggtgcgggtgctggcaggaggctgccgtgggaggggtgtgggcgggtggggtggacggcccggtcagggaagccgtgctctgagctggccccgtccacatggtggtctgagaggaggttgcttgcctctggacttctgttctatccactgactcccgggctcaagtgcaaaggatttgacttttattctctgattttaacaatgtgtcaacatcaagagaaagttgaatagctggggtgtcaatgttccctggagaaatagggttcttataagaattagagtttatgaccaggtgtggtgcctcgcacctgtaatcccagcattttgtgaggctgagtggatcacttaaagccaggttttcgagaccagcctgggcaacctaatgagaccccgtctctcaaaaaaaaaaaaaaatttagccaggcgtggtggcacacgcctataatcccagctattcgggaggctgaggcaggaggatcgcttgagcccaggaggttgaggctgcagtgagctatgattgcaccactgcagtccagcctgggcaacaaaatgagaccccatctcgaaaaaaaaaaagaaaaagaattagagcttgtctcttccaatgccttcgttctctcactgcacaaatattcattgagtacctactgtgaaccaggccctgttctggtggctgggactacagcagtgaactagagggatggagttttggccttctgaagctttccttctcagagagagacagatagtaaaggaagtaacaaataattctacaataagtgacttgaagaaaaataaagcatggggggcagggccagggtgggagtcatgttgtgttagacagggtggctggagagggtgtctgaaaggcgacatttgtgcagaggcaggagtgaaatgaagatgctgctgcgctgtgcaggaaagggaaccccaggcagtgaccacagcagcctacaagcgtgcggatgcgtccaggtggggaggcgggttttcgcggacagagtgtgtagggggaagccggtaaaaggtgcgatccgagaggagaggaagggccctggggacttgtgaggttggaaggcactggttttgagcagcaggcgacatgacttgaacggatccctctgtctctgagaggaacacagactgcaggcgcaaggcagaagcagagcccaggaggaggctgatctaatccaggagagacagcgggcctgggagcagggagggagcagcaggtctgtttgtcaggatcacgacagcactggggtgtgaggggaagccaaggaaggtggccaggcttgatgccagtccctgagacgagaaagagtgcagggagccggctggcagggaaatgcctacgggtagggaaactgagccccagagagaggctgcgattgccaccggcacacagagtggcaggttccagacaggaagccgggtctggtgcagcttcaacctccctcctttctgaatcagccaagcctcattccacagtgaggcctcttggactccaagggctatcccatccactgtcgggatggtggaaggatcatcttctatctcaggccaggactgacccagatgggagcaggcagtggagcctggggccccggtgggcgtaggctccagatccctcagtgcctggaacagagcagcagtgggagggagggagacagcgcctggccttgctgatgctgaggttagtctggagtacatgcagctcctgctgatggacaaaaccatcaaggcagttggagcccccagatcctcttgttcaggaatccccaggccatctccttgtcacccagagtaatttgttttgcttgctttactcactttcatttggaaagaaagggacccttttgtagaccagagcttgaacatctttaagctagtcagatcccctcctcaatgctcaagaccaattttaaacccatagccgagtcttcactgtcttgcgcgcccctgctgatgggtggatcactcttatagcctctccattgtgttgggggcagttgtgatatgtggaaagttcttccaccagctgagttagaggccatctcccctcattccacatgctgatgtgggcctgttctctggacaccccccacctcctgctcccactcctcatcagtcacagacacccccaccccctactccatccctgttctccctcctcacctctctgtgcctcctcacagccgtccagaatgagcgggaccggatcagcactcgaaggtcaagctatgaggacagcagcctgccctccatcaatgcgctcctgcaggcggaggtcctgtcccgacaggtaccggggtgatcctgccacccacccagggatcccccacactacagaggagctcacctcctccacctccattctccccagccaggccctggagcagctgacgggaggggcctcagatattacagaagggacactgagtccggtttcacatggcccagtttgcagcaagggcaggaatcgaacctggcgccctggggcactttctaattcatcctactgcctgcatcccacaggccaagcagagtcttcaccttcactgagggcctgcgatcagctcagctccgagagaacagagcagtggctcagtggagagaggtggcaaagtggggcccagcccttcccttgctgagtgaccttgggcaagtcacagcacctctctgagccatggttgcctcattgtcagaaaaggatgatgattttttgccctgcttctcctctaaggctgacagactccttggggctctaaagctgacagaggagggggcagggggcaggtaacaggtgaaggcacagagggagcccttctccctcatccctgcctcctccctccctccgtttttaccctgagcttccttcagagctggagggcacccactatccagccccctccccacatctgattccagggagggggctctgtgcaggggacagagagtgcgggagggcccggacatctccagcattttcttccctgtatctctcgaagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtgaggatgggcgtggatggtgggcagtagtgggcagtgggcggggcagccagggggctgctggcccacctgggatatagccgtggactggcttgattttattttatttaacaaaatatgtagtgcacacacgtgtctgaaactttaaatcaccttacaaatattaactcagttagctcctccaacaactctatgaggtaggtactaaggtactattattactgccatctcataggtgaggagattggggcacagagaggttaagtaacctgctcaaggtcacatagctactatccagcatagctgggattagaacctggcaggaagctccaaagtccaagctcctgaccattgtacctgaggctctcccagggggatgttgacagggaccctaggacagggatcaggagattttggcttaagctatggctctaagactggttgtctgcctaatcctgggcaaatgagttcctctctctgagcctcagtgttctcttatctgtaaagtggaaatgataatatccactttagagtgtggttgggaggattgaggacattggtgtctgaaaagtacaaaaatcaggtgatggggcaagctgcacagtggccagaccagagctggtctccctaaacattagtttcttccttgtttcccaccaaaacgattgaactcagcatcgtgtttcccaccaaaacaattgaactgagcatcatatttcccaccgtacatttttttggaatactgaaatgtccctagggggaagaaagggttgaaggaaggtggcgtgtgtctgaggacagatgaatttcggagatgccacctatgaagctcctgcccagagcacccctgggcctccaaagagatgttacccatctggggaagaggagctgggctgggccaccttctcagcttcggagacagactctggtgcattcgcttacccgtttcgcacctttgcataagacactgacaatgcatgtgagtctgtgaaagcttctgagaagtctcgtccaggcagttgtttgactttgcagaggccgaggcttctcaaactccttcggcaagattctcctggaacacctattaatactgcacattgggacactgtgaaaacgctggtttggcttgtccccagcctcatacaggggctggacccggggccctcttccatggttcctccttccattagcagagtcgacagggcaaggatcttggacaatccgcccctaccctctcccctgttccttgtgctctggccccagtcccctctgctggagtctctacattaatgtttaatccctcctgttccttcccaggggcttagcagggcaacaagatacccccaacctgagcaattgttaacctcgatttcccacccaaacctccctggctggggctcagagcattctcagagagcaatgatgggtggccaataacacaggacaatcattaacacaccaccccgacctcccggcccaccccccagaacagctgccatatcagggggttgaacctgggatcagaagggttcccagctccccattcctggtatatgaggagcccagcttgcccaatgcaggtggggcatccctgggaaagtcgggggcattgtcctccaaagggcttcccaattttgttgacattgccccagaaactagattcccagttggtgtgcttcttgggcctggatacaattgcagaaagagattggggcttagagagagacagaaatttgcctgaagtcacagagcaagttagcgacagaactgggattcaaatccaggtcttccgcttcgcgatgtgaaggccactggagtgactgatgaaagacttgcacagtgcccagtgcgcaggaggcgcttggcaatcagcatcctcggcctccctccatactggtcatggaaagtggattttccctcccaggcagtttcctctttttctgttttcctcacaggtttctatccatggggaatagaaggggcaaggacaagtggctgcccaggagcagctagagctagagaggaagtcaagatgtttgctcattcattcattcatttcccctttccttccttcattcaaatatttattgaaggcttattttgtgccaaatatcttcagacaaatgccttctttcctctaacaacaatttcacctccttagaggccttctctgacctccccatctaacgtagccattcttgccccattgctctcaccatcctttccactcccctccctccctccttcccttcctcccaccttttctccttccttctttcctttatgctgtgatcaccctgtgtcctctgtacttatttgttctctactatctgttcatcctctctcctataaatgttagttcgatgagattagagaccttgtctctcgtttttaaacattgtgcctccattgtcttaaaaagtgtctggcatttagtaggcatttaggatttgataactgaaagaatgaacaatcaaattaatgaacaaacaaaggattttaaccttctagtttggcttgctatggaacctccaaactccctaacccaaccttgaagatgagaagatgagatccttgaggctaccagcctggtgctgttttgtttcaagccatcctttggtcctcaggcaagcactaaagcagatggctctcagtgggctggctatgtccttctgtgagcttgctgggcccctacctatgactccagtcttagaagtcttgccttgtaccccctgcagagaatggtttcatcaagctgattctctgccaggggccagtgctcatacatttgctctgagaaggaccagccctgagacctaacatccacatccaagttcttgtaatgccctctcagaatcctggagtcctgcaatgtcgatccctggagggatctgccagaccaatgatttcccaaacagaattgcacttcagagtcaactatggagctttttaaacacagatccctgggcccaccctaaacatacaaaatcaggatcagaatctcagggcctaagaatctgtattttcaggccgggcgcagtggttcacacctgtaatctcagcactttgggaggctgagttgggctgatcacctgaggtcaggagttcgagatcagcctggcaatatggtgaaaccccgtctctactaaaaataaaattagccaggcatggtggtgcacgcctgtagtctcagctactctggaggctgaggcacgagaatcacttgaacctgggaggcggaagctgcagtgagccgagatcatgccactgcactccagcctgggtgacagagtgagactctgtctcaaaaaaaaaaaaaaaaatagaatctgtatttttacaaagcacccttcataattctccatagctggtccatgggtgggaatttgggacccacagttttggaactttttgggatcatagacctttttgagaatctcaaaaaagaaaaaaaaagcacacagaatgttgcttacagtttcatcaggcacacagaagaggcccagcacgaagcagtttcttgcccaaggacacagcagttcaaggacagagtcagcgcgaggtctctcagctctgagcacatgttctttccccttccaggtttctagttttatgggtagtagttttatgatgcccatttcacagttcaggcaggtagaggcagaggggagcattaagctgacttgcccagcgtcactgagttggctacgggcagccttcccaagggtacagatggcaaacactgttccttctctctttcaggtggccctgctcagagcccatgctggcgagcacctgctgctcggagccaccaagagatccatggtgttcaaggacgtgctgctcctaggtgaggcggctgcctgccctggccagggctccagggagggtatgcctagcatggcactcacccaggcaaggagattcacatggtggcatgcaagggtgagggagactagtcaggagtggccctgtcctcaggcttgcattagagggctccaggactcagttttcaactgggtaccccactcagatgcaaggaaatgtggatgcaagtcaccaaattcccagcattgaagtcagagcacgatcagggttatccctggaattacctgtgcatccttttttcttttgacagagtcttgctctgtcactcaggctggagtgcaatgatgtgatctcggctcacttcagcctccacccgccacgttcaagcaattctcctgcctcaccctccagagttgctgggaccacaggcgtgcaccaccacacccagctaatttttgtatttttagtagagacagggtttcaccatgttgaccaggctggtctcaaactcctggcctcaaataatccacccgcctcagtctcccaaagtgctgggattacaggtgtgagccaccgcgcctggcctacctgtgcattctgatgttctttctggagtaggagcaagaggtggttaagaatggcacaaagccccagcccgcgtcacctgtgccttcatggcatagttattattttaaacgcttgtacagcacacactgtgtgccagggactgtgctcactgctttgcaaacactacctattttaatataacaatgctatgagggaagctcgattatttatcctcatcttatagataagaaaactgaggcacagagaggttaagtaacttatccaactataaccagctatcaggggcagagccatttaagcagggcagtgcagttccagaatctggtcctttaaccttgatgctttggtgcctatcaggtgacctttgaatgtcatcgatcttgtgagtcatgttggtaaatggagcttgggtcatgtgaaagaggtcctagaaagccaagttccaagctcagccggatgactcaaggcagcttatcttctgaatctgggcctcagcttccttacctgtgaaatgggagtcaccatccctgcaggtcctcctcccacaggcaccagctatcttgccaacttaaaagccaaaactagaggagaggggtcaacccaaggtgacttcccatcctccctccctcccaacccttccaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccaggtacagtgcacacctcctaagccatccctgactctctctccagaacgctctgccagacttctcctattgggttctgtacactgagttcacagcctcatctcatgttaacgacagccaggagaggccgttttcatttaacagatgaggcaagtcaagatttgaagagacaatatggccgggcgcagtggctcacacctgtaatcccagcactttgggaggctgaggcgggcggatcacctgaggtcaggggttcaagatgagcctggctaacatggagaaaccccatctctactaaaaatacaaaaattagccaggcatggtggtgcacgcctgtaatcccagctattcgggaggctgaggcaggagaattgcttgaacctgggaggcggaggttgcagtgagccaagatcccgccactgcattccagcctgggtgactccatctcaaaaaaacaaaaacaaagggaggatatgacttgacagggcaccctgactccaaaggcctgggctttcccttcttttacttcttccctccatccttctttctctttacttcccatcttcctcttttctttcatatttgcttcttttcctcaaaaaaatttatcaaaataatatctagaaccggatgtggtggctcacatctgtaatcccagcactttgggaggcagaggcaggaggatcacttcaggccaggagttcgaggccagcctggccaacataacaagacctcgtctctatagaaactaaaaaaaattagccagggatagtggtgagcacctgcagtcccagctactcgggaagccaaggtgagcacctgcagtcccagctactcaggaggccaaggtgggaggatctcttgagcccaggaggtggaggctgctgtgagatgtgattgcaccactgcactccagtctgggtgacaaagcaagacctcatctaaaaaataataataaataaataaataaatctacacatacttaaaatgcaaatacttctccccatcctacttttccagctctaagtctactccccaagagaagcatgtctgattattttaattgtttcttctggcagtttcctcaacaattctaaatgaaagacaaagccttatatttgttgatgcatccattttggatcataatgttcctcctaggatggcagaggattttgcttttctccatcaccattcccatcttttcttccccatttttcccaatatatttttattgctatttttgagtctctgttgcaagttatgtgcttttatctttcctttcttgttctatcaactgtagacggtatctcccaacccttcacattgcaggatgaagaaaaagcattcctaccctctcctgtggctcttggctctcctctccccattctgtccactgacttttgcacctgcatttatacagaatgcatttgtcatcagtctttgtacaaaacttgcttttgtttcccagcatcaaaggtgcctgaactctggaggcttgcttgccttccctgcttacatgttagaggggacctactgtgtgccaggcactgtccttcacgctgcaaatagattacctctagtaataatagtaatgaaaaggctgggtgtggtggctcacgcctgtaatcccagcactttgggagactgaggcaggcagattacttgacgtcaggagttcaagaccagcctggccaacatggtgaaaccccgtctctactaaaaatacaaaaatcagttgtgtgtggtggtccgtgcctgtaatcccagctactcaggaggctgaggcaggagaatcgcttgaacctgggaggcgggggttgcagtgagccaagatcatgccattgcactccagcctgggcaacaagagcaaaacttcatctcaaaaaaatacatatatgtgtatatatatataatatatattatatatatataatatatagtgatatatatagtatatagtgatatattacgtataatatatattatatatagtgatatatattttatatatatatagtgatatatattatatatagagagagtgatgaagtggaagatgagccccatgtattgaatgctccctaaagagctgtttttaaacactttatgtggattgtcttacttaccaacatggtacctgtgaagtaggaattattattatctccattttacagataaggaaactgaggcatgattaacttgctcaaggtcacacaaccggaaaatggcagagcttggatttgaacttcagaccacctgtcaatcccaatttctctctctcaagcccacattcttacctaccacctgctatcccacacttaccagagggtgagatttctagttctagttccctccacagcctggcccagcctgtatcctctgtagtgctcaacacgaggctggactggcagaattgttctgcaaaatgggaaggatcactgatgctgagtcagaggcagcagcctccagcaatttgaaggggcgggggacctagttcaaggcctggcatgcaggaggtgctcaataaacatgtgtggcctgaatgaactaatgaataagcatgattcagtggagacagcccactagaaatgtgggtgaatgttctttctgccacttcctttgtccatgaaagaggaaataaatgcattacctccatgaaggttgagattaaatattgtatgaccgcttaagttcctttctaggctaaggatctagaatttattcactgatttttttttcattcattcatccagccatctaacaaaaaatatacatatagttatcaataaatatatatttatatataaatatatattttttaaaatatatatatatatagtctgtcacccaggctggagtgcagtggcaccgtcttggctcactgcgacctccacctcccagtttcaagcgattctcccacctcacctcctgagtcgctgggattacaggcatgtgtcaccacgccaggtgaatttttgtattatcagtagagatggggtttcaccatattgaccaggctggtctcaaactcctgacctcaagtgatccccccgcctcggcctctgacagtgctgggcttacaggcatgagccaccatgcctggccctattcaataaatattgactatgcatggtgctaggtggtgagtttgaaaaggcaaaggccgggtgcagtggctcacgcctgtaatcccaacattttgggaggctgaggcaggcagattacttgaggtcagaagtttgagatgagcctgaccagcatggtgaaaccccgtctctactaaaatacaaaaattagctgggtgtggtggtgtgtgcctgtaatcccagctactcgggaggctgaggcaggagaatcgcttgaacccaggaggcagaggttgcggtgagccgagatcacgccactgcactccaggctgggggtcagagggagactcagtctcaaaataaaataaaataaaataaaaatggcaaataagacatacgcgtgcccctgccaaactcacagttggatggcacaacaattacatcctgtgtggtcagcagtgatggaggggccgcagagatttggaaacaggagggacacaggatacagatataggagggtagaaggcagacttcctggaggaggtgaaacctaacctgagtccctaaggtgataggaagcaggaaccagggaaggggagcctattctaacacagtagaagcagcaactgctgaggtctggatgaggggacctcaactgtggcccaaaaccccaagttcccattgtggctctgccaacaactggctgtgcgacccaggacaagtcctatctttgcactgtgtctgggtttccccgtgtgtaagatgaggcggttgctaggtgcttattggatgcattcctcaagtcccgccctccatctcctattcccctctcttctggtttagtgctttaggaaatgtggcagaaatctttttctgcctgtgtctaggaaatcataattcatgctggcgtaccctggttgttgaggtccctgaatccttgtgcccacactgctgaagactccttgtgtgatacaagtcaggggacatctgggtcttgactccccagatgctccagctggaccctgctgccctcccttgcccaccctcttccattgtagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggaggtccgtgccaagcccaggaggggcggggttggagtggggactccccaggagacaggcctcacacagtgagctcacccctcagctccttggcttccccactgtgccgctttgggcaagttgcttaacctgtctgtgcctcagtttcctcaccagaaaaatgggaacaaggcaatggtctatttgttcaggcaccgagaacctagcacgtgccagtcactgttctaagtgctggcaattcagcaaagaacaagatctttgccctcggggaggctgtgtgtgtgtgagtatgtatggatgcgtggatatctgtgtatatgcccgtatgtgcgtgcatgtgtatataaagcctcacattttatgattttgaaataaacaggtaatatgatagagtttaactgaaaaggaatcctctttagataggggaggccacaggagacctctctgaagtggtgactcttgtgctaagaccctaacggctgaaaggaaatggaaggcttaaaagacaagagaggaatattccaagaagaagaaactacttcaagggctgcggataggagagagtgttgtgtttgagaaagaagggcaaggttgtgagatggaggacgtgtaggaggtgaagatggagattgggcagaaaccaaatcataaacatatggctttgtcagccttttcagaaatttggattttattctcattgcaactattgtaaggagagtgaaaaccagactaagtatttttattctttgagacaaagtctccctcaatcatccaggctggagtgcagtggcacaatcttggctgactgcaacctccacctcccgagttcaagcaattctcctgccacagcctcctgagtagttgggattacaggcgcccgccaccacgccctgctcatttttttatatttttagtaaagacagggtttcaccctattggccaagatggtctcaaactcctgacctcaagtgatcacccacctcagtctcccaaagtgctggaatgacaggtgtgagccgccacacccatcccagactaatgcttcaaacaaaccactctgttgggtagagagtgaattgcagattcctgagaatgtcactgtctccaatcatgtgatggatgatggaggcttggaccctggcaatggagcagtgaagataaacctgatcatctatttggaggaagagcccacacccacaggatttgctgattgatcagacatagggagtgagagaaagaggaagagtcaaggacaaagtctacatttttgctttgagtagcagaaatgacgatggagtaatttactgaaatgaggaggacagaataaacaacaagacactgggtctgggggtggtagtgaggggtgacctcagagatccattgtggaccctcttttcttttttccttttttttttttttttgagacgagatctctctctgccacccaggctggagtgcagtggcgcaatcatagttcactgtagcctcaaccttccaggctcaagagatcctcctaccccagcctttcaagtagctgggactacaggtgcgtgccaccacacccagctaattcttcattcttattttttatagagacaaggtctcactatgttgcccaggctggtcttgaactcctagccttaagcaatccttccgacttggcctctcaaagtgctgggattacaggtgtgagccaccatgcccagcctcattgtggactttcattaagcatgagatgactattacaaatccaagttatcaaggaggctgttgaatgtatgagtctgttgctcaagcacaagattaaaggcagctctgtggaatcagggggaagatggagccatggagggaagggaagaagactggccagaggggtaggagaaaaccagggcaattccagaatccaagagaagagcgtgtttgaaggacagagtgtttaatggtgttaaactctacagagaaacagaaagaagcggggaagaaaggagaggtgaagagaggaggggaagagagaggaaagggtccattggattgacagctggaggctcttggcaattgtgttgaaagcagcatcagagagctgggagagtggaaaccagattggagagtgctccaaagagagtgagtgggaaggtggagatagagtagataaccctttgaaatggtttgactatgaaggggagtatgaaggagttaggatgactgcaagggagtgattagaatgataggtcatggagtctgggctgcactcaaaaagaaataaagatagaggccgggcacggtggctcacacctgtaatcctagcactttgggaggccgaggcgggtggatcacttgaggctaggagttcaagaccaacctggcaacacagcaaaacaccatctctactaaaaatacaaaaaaaaattagccagacatggtggcatgcacctgtaatcccagctactcgggaggctgaggcaggacaatcacttgaacccgggagatggaggttgaagtgagctgagatcatgacattgcactccagcgtgggcgacagaacaaggctctgtctcaacaacaacaacaaaaggatggggtgatagtgaaaagagagtgtcagtgaattgacagtctcagtagggctgaagaatttttgcagcgatggtattagattacgggagctggaaggacatgaggtgaagtcaaagtggggatgttgaattcgagattttggaggtgtttcagtgactgaagatgacaaggcgagggtgaggtttctcaacattggtactattgatacttggaactggacaattctttgttgtgtggggctgtcctgtacattgttcagctgcatctctgtcctgtacccataaggtgccagtagcacttctccagtggtgacaaccaaaaatgtctttggatattgtcaaatgtctcctgatgggccaaaatcatccccagttgggaatcgctgttatgtgatagctcatttcattctcactttgaccctgtgaacatggggttattatgaatcaggtgtcattgagatcaggatcaggagcctgtggtctgttgccaaataattaagagctctctgggctcagttgtctcatctgtagaatgggctaataatagtatccatcctataggattgctgtgaggattaaattatgtgaaacatgggaagtgctatacaacagtacctggcacgtgataattgttaattatcaacaattgttatttatcactgaaatagatgtactgtagagatcgcttgcaagcgttgaaattccatcatcgtcatattactcaccataggctattattaaaccatatcccatgtggtatttttactccctgacatatgtttgaagcggttactgtgttccagacaatctgctaggccctcaaagaaagaagaaaaatacctctgaaattgtaatgctcatagacagaagaagtggttgttcctaaaagttgtgttacagacaaattactatgagaaatccaaggaaggagaatcaggagaggcttctaaagagaggaaatatatgagctgggatttgggcttatggacatggaacaggtttggggtggaaaaacatctctgacagaagcaacaacgtgagcagaagcatagagatagaaaaacacaggggacacatagatgctataagtaggtcagttggctgcagcagagatgtgggggatgaggctgaaaggtgaggcgggaccaaatggttgaaggacttgcactccaaggagctttgagagccattgattacatccattatgttactatgtgaccaatacactactcattagaacatttacgtgatctcagagcttccttatatgcaccttgttcctttcaactcacttttgttctcttggttttttggggtcctcttaacaccctcatgaagtctatagatgggaatggtacaccctagtttactaacccaggaataggtacccaacaggcactgccaatattggatgggctggttgattggccacgcctgaggaagatggcgtcccaaggcctgaggtctgcatcccagactctccatcctgatcgaccttctctacctgcagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcaggtgggcaaactctgggattttaccttgcaaagggtgaggatggggcttaagacaggaggcaggagaaagtggagtctagaaggtagaaccaggatgcaacagttttctgggttccagggtagggaataaagggcaagattgtccatttgttgaggctgtttattcagtaaggtgactgacagcctttactgaatgaagccattgttgggatgaggcaatccactggatgaggtaacccattgggtgaagatgttcttgggtgagaattccattagttgacattgtccattaagtaaaagtggtcattgaagtaaggctgcacagttgggtaaggctatccattagacaattagatgagactacccattgggtcaggatgtctgctgggctagaccatcctctgaaacctccaaagtataaacttgtcattgggcaaagctcttcaaaggataagattatcaatgggatgaagtgatccactgagataagatgatattttactgacattgttctcagggaaagttttccattgaacaaagatggccaattgggtcaaatttgctctccaaacctgccatgagagtgaggccaattagtttctattactcatctcctaaatatccaagaaatggtattttttgagccagctggtccggggtttcatcaactgctgctccttctcccaggaaagactatccctgtcacccatcccattgccgctggggacagccaggcctgggccttggtttgggagaagcagtccaagtctgcatatcaaataaatgatggaggagatgggtggtaggaccttccagacctcataaaacttaggctttatgatctgggactcacagaaggttgagcaataaaagaccttagggattatctggtttaattaattctctcattttatagaggaagaaattaagtcaaggtggggcagggtgggaggggagaactttcccgggcctcttcatttactcccacaaaggctggaattttgagcagcccctgtctgtctgtttgtccttccagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctagtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattcatgactcttgacagcttttctctcttcactccccaagtcaaggggaggggtggcaggggtctgtttcctggaagtcaggctcatctggcctgttggcatgggggtgggacagtgtgcacagtgtgggggcaggggagggctaagcaggcctgggtttgagggctgctccggagaccgtcactccaggtgcattctggaagcattagaccccaggatggagcgaccagcatgtcatccatgtggaatcttggtggctttgaggacattctggaaaatgccactgaccagtgtgaacaaaagggatgtgttatggggctggaggtgtgattaggtaggagggaaactgttggaccgactcctgccccctgctcaacactgacccctctgagtggttggaggcagtgccccagtgcccagaaatcccaccattagtgattgttttttatgagaaagaggcgtggagaagtattggggcaatgtgtcagggaggaatcaccacatccctacggcagtcccagccaagcccccaatcccagcggagactgtgccctgctcagagctcccaagccttcccccaccacctcactcaagtgcccctgaaatccctgccagacggctcagcctggtctgcggtaaggcagggaggctggaaccatttctgggcattgtggtcattcccactgtgttcctccacctcctccctccagcgttgctcagacctctgtcttgggagaaaggttgagataagaatgtcccatggagtgccgtgggcaacagtggcccttcatgggaacaatctgttggagcagggggtcagttctctgctgggaatctacccctttctggaggagaaacccattccaccttaataactttattgtaatgtgagaaacacaaaacaaagtttacttttttgactctaagctgacatgatattagaaaatctctcgctctcttttttttttttttttttttttttggctacttgagttgtggtcctaaaacataaaatctgatggacaaacagagggttgctggggggacaagcgtgggcacaatttccccaccaagacaccctgatcttcaggcgggtctcaggagcttctaaaaatccgcatggctctcctgagagtggacagaggagaggagagggtcagaaatgaacgctcttctatttcttgtcattaccaagccaattacttttgccaaatttttctgtgatctgccctgattaagatgaattgtgaaatttacatcaagcaattatcaaagcgggctgggtcccatcagaacgacccacatctttctgtgggtgtgaatgtcattaggtcttgcgctgacccctgagcccccatcactgccgcctgatggggcaaagaaacaaaaaacatttcttactcttctgtgttttaacaaaagtttataaaacaaaataaatggcgcatatgttttctaagtccttggataagtatcttttctttcaggtatcagaaataagactgaatcttctggttctacttgggggttaaaaaattttttttaaaggaagaatgagaatagttttatagttctttgtgatgtgcagaatgtttttgtgtccattataatttttcagtcttcacatcaagaggtaagcagttagacatgattactcccactttccagatgaggagactgaggcttgggggaagtgacttctcttggaaggcagaggtggacatctaaccctggtctcttgattccaagtacttagtatatcgagagagtgaaagttgatcccccttcttgaagaggggagtgatgaggggagagtgcaatggcaagatctggaagaatggcaagagggtccaagggtctgtcatcctccaccaaggttcaagacagaaccttttgctgggtcacctcaatctgccagcaatggaagatgagtagctgtggggacatttcataaaagcaagtggtttttttgttttgttttgttttgttttttgtttttttttctagaacaaggctgtgcacagtggctcacctctgtaatcccagcactttgggaggctgaggcgggaggatcacttgagctcaggagttcgagaccagccagagcaatataaggagaccccatctctacaaaaaatttaaaaattagccaggtatagtggtgtgtgcctatagtaccagctactctgaaggctgaggtgggaagattgcttcagcccaggagttcgaggatgcagtgagctatgaatgcaacactgcactacagcctggatgaaagaacaagactctgtctcaaaacataaataataagtaaaaagaataaaagcaagagatgcacttgagaatctccagccagatctgtagccactgggcttctctccaaggctaaactattacaggagggtggccttgtgtctcggtcaccacagaccacagcgttccattcactcggggttgtgctggagctggcttgtgagaactgactgttagcttctcttcccaactccatgtttgccagtgccacactgatagcttgaaattggttattgccggagtgtttacaccacaaggactagcaaactctacaaatccgggcttttgttcctggagagcccgttgttaacattcaccagcacaccacagcattcggcaatggctggaccatgggatgcctacatatggggacatcctccttggggatgagggtagagcagggcgatcctttcacctcttccttaagggaggggacaaaagttctggtctgggaagcacacgttttgctgatcagcgtaaccttgggcaggtcactccaccactccgagcctcatctgtaaagtgggaatgatatctccctccagggcagatgtcaggattcaatggaatgagatcacagtaactgtgagagctcccgttacatgaggagtacaagtgaactcttcatgcgcccctttttagcgagaagttaaccattaaactctccaggcttcagagcacccattcgctgtctacctgatccctagggccgctcccgccttcccctgtgccttccctccactagtcagcaccaggaaatgttttcgataacgttgcaacggaggccttgttcatgctgccgccatcggggacaagcgcgggggggggggggtggaggccagaggagactatttcagtcctaaattgtgcttaataaacccatatcaaaaccataaacccttggctgccataaattcctctacccttggatcctccacctcatcagccctttgccctggttaatctcaaatctcagcgcaggcagccggagctttaggtttggtttctacttcagttgctaaacagcatcagctcaggtggcagacagtaaaattcccattttagagatgatgaaactgaggttcagaaaggtgaagaaacttgtccaaggtcacacagctagagaccccagccaagacctgagcccatgcttccaccacccaggtagcctgattaagaaatgggaattcttggctgagcacagtggttcacccctgtaatcccagcactttgggaggccaaggtgggcggatcacctgagattaggagttcaagactagcctggccaacatggtgaaaccccatctctactaaaaatacaaaaattagccgggcacagtggtgcacacctgtaatcccagctactcaggaggctgagccaggagagttgcttgaacccaggaggcggaggctgcagtgagccgagatcatgccactgcactccagcctgggtgacagagcgagactccatctccaaaaaaaaaaaaaaaaaaaaaaaggaattctcaattctcaagcttctcggggagacagatttgaggtttcctcttacatctttgtttggtggccctacaattaaacctctttctctgctacaaaacaatggaaaaaaactggaatttctaaggctcctcattttttttttttttttttgagtcagggtctcactctgtcacccaggctggagtgtagtggtgccatcatagctctctgcaacctctgcctccagagttcaagcaatcctcctgcctcagccttttgagtagctggggtacagtgtgccagcacacctggctatttttttcttttatttttagtaaagatgaggtcttgctatgttgcccaggctgacttctttttagcacctctgaaaagttgtttccccaagccatgctactagaagcttcttattccatcattccatcattgctcagagtggggaccagaagtagaagggaccctgggtgacaggctgcttgaagatccaaagaaagtttcatgcagtgtgaatggcctgtcatcccaaattggtgaaatcgtcctacttcctcatttgtggaacccagataacctttgagctacacttctcaaatccacgtatcatatgtaaattccaggatgtgatctcagaggcctgaatcacaggatcccaggcagctgtttgacaatggtggagttagacaccaaatcatgatgccaaggacatttactgggctcttcctctttgccaaacatggctggacataatttaattcccacaacaacctctgaggctgtcattcttgtggttctgtttcacaaatgaggaaacaagaccggtcatggtggatcacgcctgtaatctcagcactttgggaggctgaggcaggtggatcacctgaggtcaagagtttgagaccagcctggccaacgtggtgaaacctcatctccattaaaaatacaacaaaaaaaaaaaaccagccaggcgtggtggcatgtgccagtagtcccgactactcgggaggctgaggcagcagaatcgcttgaacccgggagacagaggttccagtgagccgagatcatgccactgcactccagcgtgggcaaaagcttgagaccctgccacaacaacaacaacaacaaagaggaaacaggctcaggaggagagaggaagggacttgcccaaggtccacacacagctggtcaccaatccatacctggtgtggccgctgatctgatgctcattgtctgactccaggggccaatatgaggcctcgaggaagacactggtgactccatcactgcgtggtgggcacagaagtagtgtgaatggtggaaagctcatctcatgacaaatgttgatgggcagagccctgtgccgggaaccctgggattatggagaagcaatagcgtgaggcgcctccctcccagagctttcagttttcatatggacaggcgaaaattagaagcagttaagagccaaaggggtgaacgtgacagctggtgaggtggtagggagggagaggcgactgcactcagggagtggtgtatgctttgagggacgattcagaggcaataatgaggcaagacagaagtgcgctcgaggctgaggactgagcagcaagtgggaggaggcagcgggaactctgtgcatgggggcaagacgagggctggcattttccaaccttcgtgcacaggccaccttgacctctccatgcccaaggaccgctgtaacttccattacttatttttcattaaatcagttcaacatgattccccttaaacttcaggtcactgacataaataggaaaccagcatcatttgccgtaaataagaggtgactgcaaaattagtgaaaagaaaacaatgtttttcagctgcagccaggtggaatcgccccagggaaagctctgctcttgttttcgtattaaaaaggaaaactgacaaatattacagagatgttacgggcatacacgtacccaatggagactttctccttaaagctttcagaaaaggcctgtaaaggacagactttggggacaatatcacttaataccttccagtatgtttctaaaacttcccccagttccactggaagccctcatccacttctggaagctcactcactaggacagctggcccgcacacaagtggtggggacctcaaatactggacagaggagtatggaatttcttccggggaaaaggaagccactagaggtttctgtttgttttttgagaggggttctcgctctgtcacccaggctggagtgcaatggcgcgatcttggctcgctgcaatctctatctcccaggttctagcaagtctcctgcctcagcctcccaagtagctgagattacaggagcatgcaaccacacccagataatttttgtatttttagtagagatggggtttcgccatgttggccaggctggtttccaacccctgacctcaagtgatccacccgccttggcctcccaatatgctaggattacaggcatgagccgccacgcccggcccactggaggtttgagagcagtgaaggttgtaggcagatctgtatatatgtatataaagatacatatatttatatatattatatattatatatttatatattttatattatatatttttatattatatatattttatattatatattttatatatatttttatatatctatatattatatattttatatatatttttatatatttatatattatatattttatgtatattttatatatttatatattatatatttatatatatttatatattatatatttgtatattatatatttgatatattatatatgtttatatattatatgtttatatattatatatgtttatatattatatgtttatatattatatatgtttatatattatatgtttatatattatatatttatatattatatgtttatatattatatatttatatattatatgtttatatattatatatttatatattatatgtttatatattatatatttatatattatatgtttatatattatatatttatatattatatgtttatatattatatatttatatattatgtttatatattatatatttatatattatatatgtttatatattatatatttatatattatatatgtttatatattatatatttatatattatatatgtttatatattatatatttatatatgtttatgtattatatatattatatatgtatgtatgtttacatacatatatacatatgtgcgtatgtaaacatacttatatacatatgtgtgtatgtatgtttatatacttatacatatgtatatatatatatttatacatatatgtgtgtgtgtatatatatatatttttttttttttgagacagggtctccctctgtcacccaggctggagtgcagtggcgcaatcacagcccactgcaacctctgccccctgggctcaagtgatcctcctacctcagcttcctgaatagctgggaccacaggcaccaacaactatttttttgtatttttagtagagacggggtcttgccatgctgtccaggcttgtcttgaactcctgagctcaagcagtccacccgcctcggcctcacaaagtgttggaattacaggtgtgagccactgcacctggccagatctgtatctttaaaacaacaccctggctgctttgtggcagacgaagaggtgcaactgtaagctgggagaccaatgaagacacaagtgcactggatcaggtgagaggtagtgatgtctacaacaagatggtggcagtggagtagagaaaagcaccaatccaagagactttcattcattcattcattcattcgttcattcaacaaatatttagtgagtgtctatctgttgaacatttttctgagtctgagaggtaggcaggggtgagaccagaggtagccttctaggccacgagaaagattctggattttcttgttggtatagtaggaagctcttcatttttgaatagagaagtgatatgatctgcttgatgttcttaaaaggccactctctgctgtatagataatggactatgtggaaaaacagtggaagcagagacgcccacaggtggcctgggcagtggtccaggtgaaagatgatggcagcatggactagggttgtggagtgggcagaattttttaaatgccccccaagacgcctgcctttggtgcatacacaccttctttcagttatccaattagacatgaatctaggtgttcctgtgaagagattttgcagatgtaatttaagtcccaaaccagctgactttttgatagagagatattctttggtgggcctggcctaatcaggtgaggccataaagggagctgaactctttctatgaaattagaaacatgagaattagaaacgtgagaaattagaaatgtgattccacataagggagagtctctgttgctggctttgaagacaagggggccacttggcaagggatgcaagtggcctctagaaactgagagacccctggctgacaaccagcaagaaaatggtgacagggtgacagtccaacgaccatgaggaactgaatgcaggcaacaacatgaatgagcttggatcctttcctagagccctcaggtaggtacacagcccagtcgtttaagaacccgagcaggagacccaatcacaccacatctggactgctggactatagacctgtgagatcacaaatgggcagcgttttcttttcttttctttggaaacagagtttcgctctttttgcccaggctggagtgcaatgatgtgatcttggttcactgcaacctccacctcccaggttcaagtgattctcctgcctcagcctcccaagtagctgggattacaggcatgcaccaccacgcccagctaattttgtatttttaatggagatggggtttcaccgtgttggccaggctggtctcgaactcttgacctcaggtaatctgcccacctcggactcccaaagtgctgggattacaggcgtgagccactgtgcccagctgacaaatgggcagtgttttaagcatctgcatttgtggcaatttgttatgcagcaatagaaaatgaatacaggtggtggtggtgagaggcggtcagagtggagtgttctggaagtagaacagccaagaacttactaaggtatgtgaaggaaagtaactgtggccaggtggtgctgtctgttgacagaggaagactggaggagctgcaaatttgggttagaaaataagagcttggttttggatgtgctgtttgagatcccaattaaacatccagggacttgttggatatatgagtctagagcttggggaaaagttggggctagagataaagagtctaagtcataagcatagatgagaagtttaataatcaactgggctgagcatggtgctcactcctgtaatcccagagctttgggaggcgaaaaagggagaatcccttgaggccaggagttcgagaccagcatcggcaacacagcaaaacccccgtctctacaaaaaattaaaaaaaaaaaaaaaggtaggtgtgctggcacatgcctgtagtcccagctcctctggaggctgaggcaggagaattgtttaagcccaaaagtttgaggttgcagtgagccatgatcaaaccactgcactttagcctagatgatagagcaagaccctgtctctattgaagaaaaaaaagtcaataggaagattgctcagcaataaaaagaagagaactactgatacaaacaacatgggcccagtcgtggtggctctattcctagcacttcgggaggcggaggagggggtggatcatttgaggtcaagaggtcaagaccagcctggccaacatggtgaaaccccatctctattaaaaacacaaaaataagctgggtgtggtggcacatgcctgtaatcccagctactcaggaggctgaagcagaagaattgcttgaaccctggaggcggaggttgcagtgagctaagatcgagccaccgcactccaggctaggcgacagagggagacttagtctcaaaaaagaaaaaaaagaaaaccatggaactcaaactcataacactaggtgaaagaagccaggctcagaagactacatactatatgattccatctctgtgatgttctggagaaggcaaaaccatagacacaggtatgtggctgccaggggcaagggctggggtaggggtttgaataccaagggacacaggggagggggtttggagtgatgggaatgctctgagaaaatcttgattgtgatggtggtgacatgactgcatacatgtgccaaaacgtgcaaaagcatacactaaaaagggcaaatcttagtctatggaaattataccttaatttggccaggtgcggtggcacacgcctgtaatcctagcactttgggaggccaaggcaggcggatcacctgaggtcaggagtttgagaccagcctagccaatatggcaaaagcccatctctactaaaaatacaaaaattagctgggcatggtggcgcacacctgtaatcccagctattcgggaagctgaggaaggagaatcgcttgaacccgggaggtggagaggttgcagtaagccgagatggcaccactacacttcagcctgtgcaacaggagtgagactccatctcaaaaaaaaaaagaaagaaaattataccttaatttaacaaatgaaagaaatgaaaagccaatagttgcttgggctcattgaagagtgaagagaggaaacagaaaataggtgaggacttcactctaggttgcaccaccatggaggttggagagagggaaagggaaagctgcaaagaacaagtgaggtgaatagaggccgggcatggtggctcacgcccgtaatcccagcactttggaaggctgaggtgggaggattgcttggagcaatcctcaggtccctaggagttcaagacccaccagggcaacttagtgagaccccccgatctctgcaaatataaaaaaacttaaccaggcgtggtggtgtgtgcctgtagccccagctacttgggaggctgaggcaggaagattgcttgaatccaggagttcgaggctgcagtgaccgtgaccgtaattgtgtcactgcactccagcctgggaaacagagtgagaccctgttgtaaaaaataaaaacaaaaaagatgaatatagttggtgaacgaaagggattcaagcaaatttgttgcagacctactaggtgctaagtgtgctgacatactggtcttacccactcaccttactgagattgttggggaggtgaaatggactagccctgctatacggatgagaggaaagtggtttgccctgggtccacacacagcataatagtggtgaagtgagaatatccatgctggtgtgtcctgcacactcttccctttgtatcaaatgagtggaagaatgaatgagtgaatatcactgcaggtgctgaggtttcactagcagattccagccaaggatctgagaacgtgatatttttagcgaagttggggccataaaacttgttccatttcccaacttgtgcaacgcccagcccctccccctgtggctctgagattgctccccggccttgggaagggctccccaggcttatctaggggggagagtgaaactgtaaaagcctttatggctttgagatcacgtctgcaaggggcagcgattgtcgttataaacttgagctggccctgcaagggagggcaatagcctgggctgagaggagtcaggggagagttgagcaatgccaagggagcggccgtgctgagccgagcattctggggcctgtggtcagggaccatcattcatttacctcatttcatcctcacataaaaccctgtgagtttttttctttttgagacagatcttgctttgtcacccaggttggggtgcagtggctcaatcatggcccatggcaacctcgatcccctgggctcaagtgatcctcctgcctcaccctcctaagtagctgagacaacagacacatgccaccatgcttggcaaatttttaaattttttggagacttagggtctcactatgttgcccaggctgatctcaaactcctgggttcaacttgtccccccacttcagcttgcaaagtgctgggactgcaggtgtgagccactgcgtctagccttattgcaatgtttttaaacattctatgacatgccctttttcacattatggtatctctgaaatcaggatgcgtctttaaatcaatggcgtcccacaattgctaagggtttgatcaggtggtagccctgacctagttggttctggtcattatttccagtggcctaactggacaactgcaccccctttgtatttcatcaaaaatgacttaaggaccatttgaggaagggaccagagtcctgcttgtttcccaaaaccttccattaacaccttctgataagatcaagaaagcacctggggcaaaacctgcagaataggaggaagtgggttgggaggaaatccaggagacaatagtggagtgttttttcaagaaatgctgcatgggccgggtatggtggctcacgcctgtaatcccagtactttgggaggccaaggcgggtggatcacgaggtcaggagattgagaccatcctggctaacacggtgaaacctcatctctactaaaaatacaaaaaattatccgagcatggtggcaggcgcctgtagtcccagctactcgggaggctgaggcaggagaatggtgtgaaccccggaggcagagcttgcagtgagccgagatcccaccactgcactccagcctgggaaacagagtgagactccgtctcaaaaaaaaaaaaagaaaaaaaaaaaagaagaaatgctgtaggaacaaagcattaatgggatggaagttgatattgcatggaaaaatatggacaatgaagattctgggcagaaaagtgacctcagtgggctggatgctgactgtgagattttgaaactccttacctaatctatcttacccagattttcctttttatgtgtgcacaagggtgatatatgattttttattttcttgagacagaatcttgccctgtcgcccaggctggagtgtaatagtgtgatctcagctcactgcaacctccaccttcccggttcaagcaattcttctgcctcagcctcccgagtagctggaactacaagcgcgcaccaccacacctggctaatttttgtatttttaatgaagatggggtttcaccatgttgaccaggctggtctcgaactcttgacctgaagtgatctgcccacctcggcctcccaaagtgctggaattacaggtatgagccaccatgcctggcaattttttttttttagatggagttccactctgtcgcccaggctggagtgcagtggcaagatcttggctcactgcagcctccacctcccaggttccagcgattctcctgcctcagcctcccgagtagctgggataaaaggtgcccgccaccacacccggctaagttttgtattttcagtagagatgggttttcaccatgttggccaggctggtctcaaactcctgacctcctcccgcctcggtctccaaaagtgctgggagttttacaggtgtaagctgcagtgccctgccaatatataattttaaaaactatgtctaagtctcaaagagccttttaataaatagaaaataaaaattctaagtgataaggaggcattgtcacaattaattggcagtgtcttttctaagtggtacataaaatgctagtgctgcttacagcagaagcatctccagtcaggttatctcatttcacagatgagaaaactgaggacacagaggccacagggcaaatcagtgatggtgccagggctctctctgacaacagatactgtgctcttcctgacacctgaggatgacttggatgtggattagccccctggctcttcctccctcaaaggtcttggtcccagccagacaactccaactctgccatcccaagggcctctgggaggcagtaagttctcctattgttcaaaactcaggccagcatggtggctcacacctgtaatcccagcattctgggaggccgaggtgagcaaatcacctgaggtcaggagttcaagaccagcctggccaacatgatgataccctgtctctactaaaaatgtaaaaattacccaggcatggggtggtgggcacctgtaatcccagctactccggaggctaaggcaggaggatcacttgaaccggaggctaaggcagaggttgcagtgagccaagatcacgccactgcactacagcctgggagacagagcaagactccatctcaagaaaaaaaaaccaaaaaactctagctgaggagggttagccggaagccttcttcccaatgtaccaaccacccctacttcccactgctcacctcagcaaccccagtctggccaagtccatcccaacccatgctgccacacgcccttcatgctcttcctaggacatttaatcacctggtcttgggccaggcagactggactctcccttcattttacagacaaggaaactgagacacagagaggctgctggactgttgcaggcaagtcagggaagggcacggtctggaacccagggctcaaaatgcagtgttctttccaacttcacagatttcttagatccagaagaggcaggctggcaagggacagcaagggactcagagtgagtcaaaagaaaggacttccagatcagaaggattggtaagacctgaacatgtaattgtgggatgatgccaaaggtcttcacctgactcttgtcaacactaacaggttccgggacagctgcactctagggggccagtagaggcaccatcttgctcaaagaatggggccaaactacaccaggcatctctaccatccccatcagatcctacctctctctgcttaaaaccctccaatggcttcccatcattcttggaacaattttaaattcttcaccagggccccaaggtcctacagaacctggttcctgatcacgcctatgagatcatctccccatggtcactccattccagcccccttgggctcctccctgttcctcaacacactaaagctgttcccatttcacagcctttaccctaatgttccctttatctggaacattctgtcctcagctcttctcatggccacttccttctaaacattcaggtccctactcaaacgttgcctcttggagaggccttccctgatcacttggctaaatacacgaggctttgcaggatatacagtccctgctgcaactacttaagtctgctcttacagcgtaaaacagccataagcaatatgtaagtgaatgggtgtggctgagttcaatgaactttatttacaaaagtaggcagtaggctggatttggcctatgaatgtagtttgcttactccagctctaactaattgtcttgtttgattgtcttcctctatccttccctctctagactgttaactccataagagcagagactctagtctcattcaatgctgctgtggtagccagcctccaagatgtcccccagtgatccccatttcctggtattcccaccattatttactcccctcccaaactgagtagcgttgtctgtgtaatcactaggatattgtgaaaaagatggagtgtgacttttgaggctagatgataagaggcattgtggatttcatcttgccaccttgaatcccttgctctggggatgccagcagccatgctgtaaggacactcaagcaatcctatggcaaggtccacatgggaggaattgaggcctcctgccaactgccagccatgcaagtgagccaaattgaaagtggattctcaagccccagtcaagctttcaggggatcactgtcccagctggtattttgactacaacctcatgagagatctaagccagaaccatccagccaagccatttctgaagtcctaccacacagaaactatgatataatacatgtttgttgttttaaaattaaggtaattagtaattagttatgcagacatagatgactcacatagttgcctagcacagtgtctggtcacagaataaataggctaattaatattggttaataaataagtgcttaataaatatagaaggacacattataaaaataaatgtttggggccgctgcggtgagtgcattctcactcaataggcgccaactaaacttttattaaaataaaataaatgtttgaaagacaaatgtattatagtttttatataaataaatgtaaaaatatacattaaataatatagaagggcacaattaaaattttcctaatccactgatagtccttggacaagatgcctatataagaattctttcaaccttgagatcctaagattcggagattctcagtttctgtgtataattaatgctaagtctaggattatataattctgagactttaggcttctgtttcaccaagtccatggctctaaaagcttgtgattctaacatcttatgattcatttatcaacatatatcttggctgaacaactcttctctgccaggcacagtgctgggtgctagggattcagtagagaaaagatgatcccgatatctgccctcctgtggctcatgagtggatggggacacaggcaaacacacgggcacacatgatgtagtgatctctgtcacatggtaagcacagcagctggggtggggactgtggtaaatgaaggaacaccaacccagatattcaggagggatgtgagcagaaactgtcctcagagcaaacaggaagagagaggacttcaaccagagaaggaggtggtgttgtagactgtgttccaggtagcgggaacagccagtgcaaaggtccaggggtcaggggagagagccagcatccagcacatctggtgaagcaaaacaagttctgtatgggttggtatagagttgggggtggggggcggtagaaggcagagtggccagactgtggccagatgactgagaacctagtaaaccatgtcaaggagtttgaactttatcctgagggcaaaggggagccagggaagggttttaaggggcagcagagtggcacaatctgcttggtagtttggaaagatgcctctggctcctgtgtacgggtttggaaggaggagagacaagagacaagtctggaacaagatcccaggtgagagaagaggcctgagtgaatgggaggtgggccccagagagacatttcatttacagtgtggggaatggacagggagttggtggcagtgtgggttatactggtaacctaggagcccaggactcctagattttatgattctaaaattcttggccaggcacagtggctcatgcctgtaatcccagtactttgcgaggccaaggtgggcagatcacttgaggtcaggagtttgagaccagcctggccaacattgtgaaaccccgtctccaccaaaaacacaaaacaattagccgggcctggtagtacatgcctgtgatccctgcgactcgggaggctgaggcaggaggatcccttgaacccaggaggtggaagttgccctgagccgagatcgcgccactgcactccagcctggttgacagattgagactccttctcaaaaaataaaataaagtaaaattctctgattctgtgttcaacactccatcattcttcaacacaaaatgttcaatgatatcaccatatgtgtaggatgcccaaccttaccgccctccatccctcctttctgagcttcagttttccttgtttacaaagtgaggatcattaacactgtccttgcaaagcagccgtgggagtgggagacggtgtgtactcagcatctgcacagaaatgtggtccatcatggcaggcgtgtttgtctggaagtgctcaacacacaggcactgtcaggaaagagccgggtgttgagagaacaagacatcagcagggaagagcagggcaggcaaggaagagcctggtccttgtctgctcctggagacctgggctgctctggcctcccggcttctgcctgggcatctgatacccagatttggttgtttgcttccgggtaccgacaagtttacatgttgtttgtggaattccccatttctgcagctggccagaaactcccctttcctggtcttaaactcccccaagggctacagacaccagctgggggtagccaggcaagatctggtcttccctggactgatctaagccagatcaagtcccaacctgctcacactctagcgccccctctaggtcacactataggcattcccttcttagacaactaactgtccattggctccagcaagagcaagtctttggagacagaaccctcactcctctccccaaaacacatggtctcctgaaccacacccaaggtttatgtgtctcctgcattctaatttgcttctcaccaatggttcagttttaattcagtccaatccacaaaacatccattgaagccgggcatggtggctcacacctgtaatcccagcactttgggaggccgagacaggtggatcacttgaggccaggagtttaagaccagcctggccaacatggtcaaaccccatctctactaaaaacacaaaaattagcagggcgtagtggcgggtgcctgtaatcccagctattcgggaggctgcagtgggagaatcgcttgaacccgggagacagaggttgcagtgagctgagatagctacactgcactccagcctgggtgacagaacaagactccacctcaaaaaataaaataaaataaaataaaataaattgaacaacataactgtgacaggcttacccgttgcttggagaaagagatgggaggccagcagtggtgggcctgaagctgccagtgcttagtggatcagggttgggcttagggtgtgaggccagagagctcagttcatttctttgcacacagtaggggctctgtaaacacccgtgaaattaaatcaaattaggagtttaagtgacacaagctagcatgtgcaccaactatttccggaaggcgatgagagaccggagagtgagatggctttcggggtgggtgttggggggctgggtagctggggtcggggtgggaggaagacctacttctcattttatgcccttttgtaccttttgaaatgttttactttcaccacatgcacacagagcagaatcaatcaaacaaacaatcacaattaaataaacaatgcagggagccaggctgtctcagagctccatggcttcatgcctgctcttcctgctggtgagatactgtttcccagctttctccaactggggaagtacacgtcctccaagaagtacacaaatgtcctgtcttctggggcctgttcctgcctccctgtgatggttcttctctgcttacccacctcatccacacacgagtggtccaatctccaaccctgtctgtcctgctctgtggcctggaggcacctgtgccttctgacatcacaatacattcagccaaggggaggaatcggcagagataaaagggcaggatgagggagaactgggcatgtttatgccacccccagctccctccctgttttgccttaattttggcagtggctgaatttctccatggtcttaactcctgtcttagcctcacttatatggctccagctatctctgggtcaagtaacaccattctctctctcacctctttggccttggggtgctaacagctccccactgttgccagtccctgcatgcctcacctctgcaaacacttccttcattaagtttgcttcagttaagccagtggttcacaatctggggtgactttgcccccaggggacattcggtgatgtctggagacactttaggttgtcatgactggtagagaagatgctactggcagaggcaacagatagtgctaaccatcctactccgcacaggacatcccccacaacagaattagccagccccaaatatcaatagcacggagactttgggtctcccactgctccctgcctgaagcccgacagttcatggctgggattctggactcctgctggcctctctgctttgtggtgtgatctgccagtttccacacctgctgttgatctcctcttagtgacacagagatgaaaagaccccatccttgccctcaagctggccatagtgcagtggagagagaccctggtgagcggggttccccagcagcctcgagtccttgagggcaaagtctctttgtcagtcaccacgtagccccagtagtaggagagcagcagacatttgccaattgaaacaaaaggtcctttaaaaatatcttaaaacaaggccaggctcagtggctcacgcctgtaatcccagcattttgggaggccaaggtgggtggatcacctgaggtcaggagtttgaaaccagactggccaacatggtgaaaccctgtctctactaaaaataccaaaaaaaaaaaaaattatctgggcatggtggtgagcgcctgtaatcccaagccactactcgggaggctgaggcagggagaactgcttgaatctgggaggtggaggttgcagtgggctgagattgcgccactgcactccaacctgggtgacagagcaagactctgtcccccccaccccccccaaaaaaaagtcttaaaacagacagaaggttaggctcaatggctaaacaagacccaggaaaccctggtgagtttccctgtaacaaaagttccaaggaaaccacaatcaggcaaagatgtaccaaatgaatgaattctagtcccaggggtatgggtgggtgagtgggacagaagacaactatgagcatcccgtctctaaaatggttataatggtagaacccacctcctaagattgaatgagattaaatttaatgaaaatcacttacagtgttacctagggcatagtgagcaccagataaacagtatccaccagctacctggaggaaatgatggggcagcagcttcaagacgggtctagggaagagctctgccgctaatattggactggtttgcacccctgggcctcactttcccaatctgtaacgtgaggaaaatataagcaagattagtgttttgcagaaattatatcatagggatgcttgagaggggttctacaatacgtagtgcaaatatcattttcaacatcaaacctgtaatttaatacaagtaaaaggtcagtctgttaaactggagggaaatattaccatcaggcagggctagggtgaccaactcatcctcttttgcccaggacttgtctagttttagctctgaaagtcctgtgtcctgaaactctccctcagtctcagcggattaggatggctggtgaccccagcaggtcaaatgatcagcttgcccatactaattttaaagataataaatagctagctgcccgacacagtggctcacgcctgtaatcccagcacttagggaggctggctcgggcaaatcacttgaggtcaggagtatgagaccagcctggccaacatggcgaaaccccgtctctactaaaaacacaaaaattagctgggagtggtggcagatgcctgtaattctacctacttgggaggctgaggcaggagaatcgcttcaacccagcgggcagaggttgcagtgagccaagatcgtgccactgcactccagcctgggcaacagagcgagactccatctcaaaataaataaataaataaacaaacaatatatgttgaatacttattttgtgccaggcactgacttcacaagtattagctcatttaatctttataagaacccagcaaggtaaatattaacatctctctttatacaatcgcacagaaaggttctgtaattgcctgagttcacacaactcctgagtagtaaagccaggatttgattccaggccatctgggtccagagttgccatatttaatttgacctgtgctatatatttgaatatatttttattttttattttttgagaggaagtctcggctctgtcacccaggctggagtgccgtgacatgatcttagctcactgcaacctctacctcccggcctcaagtgattctttagcctcagcctcctcccaagtagctgagattacaagcatgcaccgctatgcgcagctaatttttgtatttttagtagagatggagtttcaccattttggccaggctggtttcaaactcctgacttcaagagatctgcccacctcggcctcccaaagtgctgggattacaggcgtgagccaccacgccaggcaaatatatttttaaaacgtctttggagacagtaataatatcaataatgatgataataataataatggaaatatattttaaaacatttttgaaatagtaataatgacaatacatttttgaacactgaaatatgcatcccaaaatttaacactatggaggccacgtataaactaacttgagctgcttgattagcccattgttgtgcagaccttagaataaagcatttttggccacctctgctgaattaaagctagaatggaagactcaaatgtttacagggccaggtgggtgatgtcagtgagtggttttagggcaacagagagtggtggggactgtggcaaacgggaatagaatgcatgagctgagaagatgcagccaggactcaactccaggcacttggaattggggaccagcaatggcagatccttcaggaggagacaaacatccatctttatcagcaactaattcaatgaaaacaatacaaaaacacaaggtgtgtgaaacaaaacgtgcctgtgggtcaaacccagttcctgctctccttccaccgctgccctgcccaaattgaatgtgtgctcagattatcaggaaagctgttaaaaacaacaaccacaacaacactggccaggtgtggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaaccagggaggcggagcttgcagtgagccgagatcccgccactgcactccagcctgggcgacagagcaagactccgtctcaaaaaaaaaaataaaataaaataaaacaaaaaactatttgaaactgtggcatattcattcaatggaacactatacagtaacaagaataaactctagctatgaaaaatatggatgaatctcacaaacataagccagacacaaaagactacatcctgtgttattccgtttctttaatgtttaacaacagacaagactcatctctggtgtcaggagtcaggcttgtggttaccctggagaggggtgctagtgagtgattgggaggggcaaagggaagacttctgggagcctggccgggttccatttcttcatctgggtcccagtggcatgggggttctctttgcgatgattcattgagctgcacacttgagtttgtgcattttttgatgtctgttttttggtttttgttttcttttgagttgaaatatttgtcacccaggctggagtgcagtggcacccaggtggagtacagctcgctgcagcctccaccttctgaggctcaggcaatcctcccacctcagcctcccgagtagctgggactacatacaggcacgtgccaccatgcctggctaatttattattattatttgtagaggcagggggttttgctatgttgcccaagctagcctccaactcctgggctctagtgatcctcccgactcagcatcccaaagtgttaggattacaggcattagccatcatgccaagccgtatgtgcgttatacttcaaaatttatgtaaaattttttgaaacacatacacagaaaccattaccatttggaaatatttctctggacaaagcaggattgtgtttggatagaagggaaaacaaatgaggaaataatccattccaagtatgggaagcatctgacgaccctttgctgaatagggtgaaaagaatacaattgtcagggctgggctcaccactgaactccagcctggacaacagagccagaccctgtttcaaaaaaacaaaaaacaaaatgaaaaaacaaaagtgtctccttggagaggcctttctaggaagcaaccttcccagttacttcctcttagggtactataacttccccttaggaaatgctgattacagtctgcaattcccttgtttatttggggttttctttcttttttccttttttattttttttgagatggaatctcgctctgtcacccaggctggagtgcatggcaagatctcggctcaatgcaacctctgcctcctgggttcaagctattctcctgcctcagcctcccaagtagctggcattatgagcacccaccaccatgcctgtctatttttttgtatttttagtagagacgggatttcaccatgttggccaggctggtcttgaactcctgacctcgggtgatctgcctgcctcggcctcccaaaatgctgggattatggacgtgagacactgtgcccggccctttttttctttttttagtttattgtctatctccccttcatgaagacaatgattttgcctgtcttatccatcacctggcacatagcaggtgtcacaaaatatttattaaatgagtgaagagaagaagggagggagagaaggaagaacaactgagtggataattgggagttaacaaggcaaagctgggggcagttggaagctgtgaagaccgatgcgactagagatgagagaccagggggtgcggcaggcaagatgatgtccattttacagatgaggcatctgaggctcagagatggcaaggggcatgaccaagtcatccagtgggacaggtcctggatgaatccagtttccgactcaagagtcaatagaacctcagttactgagcactcatctgtactaactgatgaggtgagtattgttattccttcctaaggcacagccaggaacagtggttcatgcctattaatctcagaattttgggaggccgagataggaggattgcttgtggccaggagttcaagaccagcctgggcaacatagtaaaacctccatctctaccaaaaaagatttttcgaattagctgggctcggtgatgcctgcctgtagtcctagctgctcaggaggttgaggcaagaggaacacttgagcccaggagctcaaggctgcagtgagctatgatcaggccactgcacttcagcctgggcaacagatcaagaccatgtatcttataaaaaaaaacaaaaaacggtggggggagccgggcgcggtagctcacacctataatcccagcactttgggaggcctaggcgggcagatcacctgaggtcaggagttagagaccagcctgacaaacatggagaaaccccatttctactaaaaatacaaaattagctgggcatagtggtgcatgcctataatcccagctactcaggaagctgaggcaggagaatcgcttgaacccgggaggcagagtttgcggtgagccgagatcgcaccattgcattcctgcctgggcaacaagagtgaaactccgtctcaaaaacaaaacaagacaaaacaaaacaaaaggacctaaggcacagagagtttgagtgacttgcctaaggtcacacagctaagaagcagccaagcctcagggcttttgtctactctgaatggctattctccaccacccaccccaccttgctgccaactctctgctcggaccccagcacggtctatgaattcaaaccctaaccctttctagagctttgggcaaagccaggaaattccatgaaaccccttcaaggcctgggttccagttcccccaactccaaaccaaaagagagcaaaactagccctccttgcaaggtggctgtgagaaaacagtgataaaaattaattataggacttgtatgtaataaaaataattgcagggctcctggcaaacagcccagctctagagatacggactgatgatagcaggcatttatggccctgcggcccagcctttctgaggctggggtgataggagccgggtcacgaggtgggggtggtcacaggcaggaaactcccagcagcaaggcctgggcctgtctctgatgcagcctgcacattggtttcagggacgcttggaaggacactcccctagcctcggggggtcaccattagttatccatctggttgggtctgatgttgcttgctgtttgcctttctaaaaacctacaaacaaggccaggtgtggtggctcacacctgcaatcccagcactttgggaggccaaggtgggtggatcgcttgaggtcaagggttcaagaccagcctggccgacatggtgaaaccccatctctactaaaaatacaaaaattagctgggcatggtggcgggtgcctgtaatcccagctactcaggaggctgaggcaggagaatcacttgaacccgggaggcggaggttgcagtgaaccaagatcgtgccattgcactccagcctgggccacagagtgagactctgtctcaaaataaataaatataaaaacctgtaaataatgagcactttacagtgacttcattcattcgttaattctcaaggccccaaggataggcagggagcagatattggtggtggtggaggtggagcaaggcccagaggagacagtggttcattcttcctctatccaatggatatttattaagggccactccatgccaggtgcctcgctgttggaaggtagtgacagggacaccagggacttgcccaggatcacagtgggtgggagaaagtcagggctggcccctgggtcctcaacaccaaggacagtagtctcattgccacaaaaagagaccggagtggtttgtccctttggaaaaatgactccctcttaggattctagccttccctgcaggcattcatagttaattcttaaagacatcaaaaacccatattagaactccagtaatttttttaatgaaaacggaacctacttatcacaaaagctcaaccaataaagagaagtacaaataagaaagttcaaaatgtggaaattttactacccagagaaaaatgctcttagcagaggtagcagagctaagtggtcaagagcacagactcagaccaaagtgcccagggccacgtgctggcttgcaacctaaccatgctagagtgtagcctctctgctgcctatttctttacctgcaaatctgtataatggcagcacctgtcacacatagggtattaaatgttaggagcatgaaacaagctaaccatttgtggagtgcttagcacagcactcaacacagaataagtgctatttaaagggttgttcagtgtatccccagacggggctccatgcagacataccacacctgcttatggtcttaggacctgattttatatatgtatatacacatatatatgtatatatacgtatatatatatgtgtgtgtgtgtgtgtgtgtgtatacacacatatatacatatatgtatacacacatttatacatatatatatacacacatatacacactaaacaagatattccaggcacattgccatgtctataagcttctttctataagtaagaatttgatttaggctggagacagtggctcacacctgtaatcccagcactttgggaggccaaggcaggaggatcacttgagcccaggagtttgagaccagtctgggcaacttagtgagacctccctaaggtgttgcaatgtgcagctgtagtcccaactaattgggaggctgaggtgggaggattgcttgagccttgggaggtagaggttgcagtgagccaagattgtgccactgcgctgcagcctgggcaacagagtgagaccctatctcaaaaaaataaaaagaatgtacgtttcatatcggtagaaactttctggctgtttcaggtcctaaaagagtgcttggcacataatagatgtgcaaaaaaaaaaatgttgaatgaatgaatgactctaatttagtcaatatccatgacaaagggatctgttacatactgggtgtgtgactttgagcaagtatcttcaagcctctgaacttcagtcttctcctaggtttcatgggtatgacacagataacatgtactgagttaactctgtgctgggactaatttgaagtggtttatatggaatatctcctttaaaccatacaacagcatttgaggtactattattagtccatattaatgtggagttagctgaggcataaggagattaagtaacttggctaaggtcacaagtaagaggtggagctaagagacaagtcccccaggcctctgataccacagtgcattcacttaccaccactctatactgcttttctaagataacccacccttggccaccgacagtagaaggaataagtacatggtggtacatttgtacaatagaatactatacagcaattgagtggctcatgggctgggaaccgtggctcatgcctataatcccaacactttggaaggctgaagcaggtggattacttgagctcaggagtttgagaccagcttgggcaatataccaagacccccatctctaaaaaaaagaaaaagaaaaagaatactatacagtgattaagaagagcacattgatgccaggtgcggtggctcatgcctgtaatcccagcactttgggaggccaagacgggaggatcatgaggtcaggagtttgagaccagcctggccaacatggtgaaaccctgtctctactaaagatacaaaaaaaaaaaaaaaaaaaattagccaggcatggtggcacgtgcctgtaatcccagctacttgggaggctgagacaggagaatcacttgaacttgggaggcggagattgcagtgagctgagatcatgtcattgcactccagcctgggtgaaagggcaagactccatctcaaaaaaaaaaaaaataaaatgacatcctgaatttttatggcaaccctaaagtttgcatatgtatgattccatttatgtgaagttcagaaataagcaaaacgaataaatggtaatagaatcaggagcatggtttcgttgggtgggagtaggagtgagtagaaaggatattagaaaagctttacatcttgatctggatggaggttacctgtgtgtatacacatgtaacaattcaccaagctgtacacttaatgtttttaccttttacaacacttgtgaattacaactccataaaaaaatatttttaggccagttgcggtggctcatgtctgtaatcccagtactttgggaggtcaaaggccagcttgggcaacatggcaagaccctgtctctacagaaaaattaaaaaatcagccaggtatggttgtgcatacccgtagtcccagcttcttggaaggctgaggcaggaggattgcttgagcccaggagatctcggctactgtgagccgcaattgtgccactgcactccagcctgggcgacagagtgagaccctgtctcaaaaaaaattatatatatatacatatatatatatgtgtatatatatgtatatacgtatatatatatgtatatacgtatatatgtgtatatatatgtatatacgtatatatataatacacaaattttttaaatcccacagagcgatatgccctattataaaatctttgataatattctctaactgatgggatgtttgcaaggttaaaatgtgataaagtttgtgactctcttgctacattttaggctctcatagtaagaactcaatgttaaatgtaaacagcattgttaaatgtaacagcagcattcatacagcatcgttattatcatggctttttgtatttctctctattgctgatagactggagcgccctcgagtgtttaatttgttatagtacctcagttattacaaagagcaccctaaacccaagtttgtagtctcaatgccaaagggcaatgcttttcttttctttcactccagtgccacataaaaaaggaccaaaacatgacctcctgggagcaaagaaacaccaggttgcctaaggagaggtgaactggcccaggctggaaacagagcaggtcaaatctcacgccctgatcagtggtgggatcacgcctgtgaatagccactgcagtccaaactgtgagactctgtctcttaaaaaaaaaaaaagtagcaaaattcacatcaaatcaatgggtcccaaggccaactcaagccctgcccatggtcactccctgaaatgtgtcagaaggaaggcagaagggaacacgcagctctacctccctttgatgcaagcacattgcaaatatcatctcgtttcacaggaactcacataatatttgaatgtggcatcatactgactacaaaaatcctttcatattactaatagtcacagctagctttcagtgacagtttcctgtgtcccaggtaccctactaggagctagatgtcattgttagctttgatctttaaaatggcctgtgaggcatatattcttttgtagcctgcttttttcccttcagcagtacgctttgggcatctttccatgtcaataaatagagctgggtcggaagtaactgattcaaaggctgagaaacttaaacagtcagcagccactgcccaggtgaagatcaataatagttaacatttattgagtgctttattacacaccaggccctccactcattgtttaaggtgaactctctcgcatttgatccttgaggcaatcccaaggtagcttctattattattcagatggggaatctgaagcccagagaagcaaaggaacgcagtcaaggtcagacagctggtgttcaatggcagaggtgggattcaaacccaggtccctctgattcaggcgctgggctctcagccagcacatttggaggacaacatggaggaggatgtaaggggagtcttcgaagtgggaaaaggatccactagcaaaggctgaagacaggcaggagggtggtgtgggcccaggccactgtcctccatggaagtgacagtaaggcttcctggaggtgacaccgtttggactaattctatgtctccagacaataaaggaggtctttttatagcttaccagttcctgggcatacgtccagtgagacatacgtgggttcaaatcttcattgtgccactctagtttaaaaaaaaatcagcattatcgccagacacagtggttcacgtctataattccaacactttgggaggccaaggcaggcgagtcacctgaggtcaggagttcgagaccagagtggccaacatggtgaaaccccatctctactaaaaatacaaaaattagctgggcgtggtgatgcacacctgtaatcccagctactcgggaggctgaggcaggagaatcatttgaacccagaaggtggaggttgcagtgagccaagaacgtgcctgggtgacaaagtgagactcagtctcaaaaataaaaataaaaaataaacagcattgttgagatataatgatgttcaataaactaaacatacttaaattgaataatctgatgagtttcaacatatgtacatacccaaggaaccatcaccacaatcaagatgccaagtgtttccatcgcttccaaaagcttcatgctcgtttataagccatcccccattcatcccaccaccccattcccaggtaaccatcaccaatataggttgctttctttcactatagatggctttacattttctgggattttatagaaatgaaatcatgctatatgtactctgtcttaatttttttttttttttttttgagacagagcctctctctgttgcccaggctggagtgcagtggtgaaatctcgggtcactgaaacctctgccccccaggggttcaagcaattctcctgcctcagccttagtagctgggatcacaggcgtgcgctaccatacctggctaattttttttttttttgtatttttagtagtctcgaactcctggcttcaggtgatccgcccacctcagcctctccaagtgctaggattacaggcgtgagccgctgcgccccgcaaatatgtactctttctgtctgacttctctcattcaggcatgaaccaccatgcctggccatttcgccattacttttaacggcaaaaaccgcaatcacttttgcaccaacctaatagatctcacaggtgaagcacggtggctcacacctgtaatcccaacactttgggaggctgagacgagcagatcacttgagcccaggagtttgagaccagcctgggccacatagcgaaaccgtgtctctactaaacaccaaaaaattagccaggcatggtggcatgtgcctgtctgtagtctcagctactcaggaggttgaggtgggagaatcgcttgagccctaaggtcgagctgcagtgagccgtgatcgcaccactgcactccactttgtctcaaacaaacaacaaagaaagatacagaagccatagtttcttcacccatgcccctgggcatgtcattgtttcccccagtttttgcctattacaaataaaactgctatgaacactcatgttcatgtctttgagaggacaaacgctttcattatgcaggaatacaattgctggtcacataagtgtgtgtttaactttttaagaaactgcaaactacttcccagtctggcctttttaattatagtcattttagatgcactcattttttttaacctgtggatctaatagatggtttcttagactgtctggacctcagtgttttcatgtgtaaaatggagataattggccgggtgcagtggctcacgcctgtaatcccagcactttaggaggctgaggcaggcagatcatgaggtcaagagatcgagaccatcctggccaacatggtgaaaccccatctctactgaaagtacaaaaattagctgggcatggtggtgtgcacctgtagtcccagctactcgggaggctgaggcaggagaatcacatgaacccgggaggcggaggttgcagtgagtcaagatcgtgccactgtactccagcctggcaacagagcgagactccatctcaaaaaagaaaggagataattacatcagttttgaaaggtagtgaagacagagtgaactagcacataagcacatatgcagcacatagaacagggactgggacatagtaggggttccataaacggtgggtttttgttgttgttgttgtttttgagatggagtctcgtgcagtgttgcaatctcagctcactgcaacctccgcctcccaggttcaagtgattctcctgcctcagcctcccaagtagctgggattacaggcacgcaccaccatgcctggctaatttttgtatttttagtggagacaaggtttcaccatgttagccaggctggtctcgaactcctgacgtcaggtgatccacctgcttcggcctcccaaagtgctggattacaggtgtgagccaccagcctggccaagggtgattattttattacaattgaaccacagccatcctatgatctggccacttaccccaggatacagcatcctcaactagatggcaaaaagccacttcctttgcacttagtcagtgctgttagcctggaggaataacaatggcaccatcgattgtgccaggcactatcctaggtgcttttgtatgttgaatccttgcaaagccctgtgaggtgggtcagtgtttgccttctgtatgacagatgagaaaactgggatgtagtaactagtcattggccaaggtcacacagcagtgaagtaatggtgctgtgatttgaatctatgtagtttgatttaggatctagaagtttcgctaatggattacctagctcagaactagtgaaagagcccagtcacaaaagcacctcctgatgcccaaaatcattttcagctcctcagacacagagcctgaagcaaagattaggtactgtgtgatttataaaggaaagaacctgtaagggatgaagggaagcaagacagggagggaaacaagaaaagatgtggtctcaggtaaagtctagcaaaaaggctggctttgtgtacctctgtacgagtcagctgttggctgccagccaccctgtgggtgaggggaataaactccagggtgaggtgattcctgagatggcagttctccgtagaaatggaaatagtaagccattcgaagccaacaactgaagcatctggggggatggtgttggtgtgctagcccatgaagggctcaagaggttcccagaggcacacttcttgcctgcctaatgaatcaagttctagaacattctggaacattcacttcctagacttgttttggagaatcctccttctcactgagaccagcatgttgaacaaacccagcctgtgacataatcaaagcataccttaatttgtatctcccagtgtcctttctaagatgtatttggtagagaaacattttccctgccactgggtgaaatctccccattattcttctgcttgttctgaggaaacaggcaattctatggtcactttaggtcacaaacacaacctcaatttagaaatgagaatgtccagtcaagcttctaaccaaaattcccaatttgatttgggtttaaaccttctcccctcaccctcaggcctgcttcagggaggtggtgtgggtgactccttctctatctctccttccctcacccacccgtggggtacagtggggggtgttggagatggcaaggggagaggaagggtctcccttgagctgccaccatcctggctggcttcaagctgcccctttctgtcgtgggctccatggagatggccactgtcacaggggccctctcactcttaaccttgggggatgcatctctcctcataggggtcccttgcaagtccttcgtcagcccttaggaacccaacatccaactcaagcttcttgctgctgccacacctctgcccctccaggaggctctaggggacaggacccaagaggaccccttgtaggtgctctctgccaacactggcccatgggaaacactccagccagcagcctgtactccgaaagtcctgggaatgtggcttaccttagcacgcccacactggctccttcaccagttcagccaggcagcccgtttctctcagcctctagatgtccatgcccacatgagaccactgggccccctcataatggccacacattattctctacatatagtggcccctctcatggaagagcccccatgaccccattccacccttccagggagatggtcaccaaagaactctttgcttcctcttcccatcctaggagaatgtggtgggtataggggtaatagtaaatgtgggggttttgggtagccatggccaaattttagcagctgtgggtttggactgggctcttttttgttgttgttgttgttacgtaaattaacccatttattacaggccagtgatgtctcaaagagtagaggagcgtctactggtctttcaactccttcaggcttctgatggcggactttaccgtgatagcggaggtggtattgtatgtccaggcaccgccagccactgtcttcacgcgggaaccacagtgccagatccccgcagctcatctcttcatcttggttttgccacagaaagagcaagtgtacttggcctgctggctgatttcaactttcttcaccattttccagagggaggccccatagcgggtcccgtatttaccgacgatcccgactttcttggtaggtttggccatgtcaccgcgaactaggtccgagcccagagagttggactgggcttttaaaaaacagttactggttgtcacagcagagctttctagaaacatcttacaagtcatgtccaccacccccagcctcagttttttcatatccttactgcgggtggcagcaccttactgggtgggggtttgtggtgagggctgagtgaagtagtgaatttgcggagctaacactccagaattccacaatcacagacctgcaaattccatctccgtgggaccatttacaagtgatgtggcttctctgagtctgtttactcctttgttaaatggaagagcctctactccattgcatctctgtaaggttagttaagtgaatacatatgacatgcttagcacgggacctggcacctggtaagaactcagtccatgctgggcgtttttaatacaacggtgggtggctggtactgacggaggggatttgggatctccaccccttccgtttccctcactattccaggccctgttttggaaatgcttcagccaggctgggatccagggcccctgggaacagagaggacatactgtacctccaagcagccatgctgactcaggttaggaaatcaatgtgtgaccacaaaaacacagccaggttcttcccacttctgggaaatctgcacagccaacccatgggcatctctttaccctgtcccgagaggtggccagcttcgttctaggacctgattctgcagcttgtgagcacaaggctggcacatggagaaacaggagtctctcgctccttagggaaccccaggcccggggtcacaagctttgcacgaccctctgattggggtcaaacatgtctggtgtttgcgaagcctctgacttcccccagcctgcgtctggacacttctcaagccaagccaggctccggaccactggttgggcaacgcatgacctcaaactgggtcagacccatcagatgagcatctgtttaagagtataggacactttgttctttagaatcccaagggtcagagtatgaaccctccccgtccccaattcaaactcctcctccatcacttactgccatttacttactctgttactttgagcaagtttttcagctctctgagttctagttttcctagccaccaaatgcagactaacaagtaccttcaccttccagggttgatgtgagattcgggtagtgaatgtcaaagaatggcacacatattagcaggcactccataagggggagttattattgcaaacaggggcactagacaccaagtaaaaaacagtatggtacatatgctacagtggatgagagggcagagctgaaagccagactgcctgggttccaaaccaggctactggccaggtgcggtggctcatgcctgtaatcctagcactttgggaggccaaggcgggtggctcacttgaggccaggaattcgagaccaacctggccaatatggcgaaaccccatctctactaaaaatgcaaataaaattagctgggcgtggtggcatgtccctgtaatcccagctactcaggagactgaggcaagagaatagcctgaacccaggaggcagaggttgcagtgagccaagattgtgccactgcactccagcctgggccacagagtgagacgctgcctcaaaacaaaataatacaaaacaaaacaggctgccctgccacctcctgtgtggccacagggaaagtctctaagcctcagttttcttctctgtaaaatgggaataatcataatacagttataaggattcaattagattagttgcactggaaacagtgcctggcacatagtatcacctaataaccattaacgattttttattttgttttatttttccagtctctgccccagttgggaagcatgaactatttttaattagccacacaagttagtaatgtcggtaatggtgctgaaatcacacgggtcagtgttttgaacaaaattcacatggaagtcatatttagtgagcatctacctacatacctggtgctaacagaaaccatacatttagatacatgtatatgtacatgtaaacacacatatgcacacacacatagtgtgaagtaagtgttgctgtcctcattttttaaaacctttatattatagagcaaaacagttgcagaaaaccacacaaattaaatttgtagcagccaggtgcagtggcttacacctgtaatcccaccactttgagaagccgaggtgagtagatcacttgagctcaggagtttgagaccaacctggggaacatggcaaaacctgaaatgccatctctacgaaaaatacataaattagccaggcatggttggcacgtacctgtagccccagttactcaggaggctgaagcaggaggattacttgagtctagggaggtctgaggccacagtgagctgagatcacactactgtactccaccccaggcaacaaagtgagacactatctcaaaaaaaaaaaattgtagcttagtgagttatatcaaggcaaacaccctgtaaccaccaccccggtcaaaatacagaattttttcagccacctcagggttcccctccccacctcaccaggtactccataccaatcacagcccatccccccaaaataatcactaatccgactattaattacttccttgcatttcttcatgacttaatcatctgagtgtgcattcctagatgttattgtttagttgagtccactttttatttttatttatttattttttgttgagatggagtctcgctcaaccgcccaggcagtggcatgatctttcttggctcactgcaaccaccgtctaccgtgttcaacagattctcctgtctcagcctccccagtagctgggattacaggcacccaccatcatacctggctaatttttgtattttagtagagacggagtttctccatgttggtcaggctggtctcgaactccggacctcaggtgatccgcccgcctcagcctcccaaagtgctggcattacaggcgtgagccgccactcccggctaaacatatttgataagtttcaatcaactgcaagtattgtctttgttgcagctaaaattgtttcatccacaggctggcttgtaagtccttttggtgtgaccctggtagccttcgatagcttccttgttaattggcgtgacaagatattccaggcttattttgtatatttcctgctacagatctggaatgagtaatttcttcaagaagtctttttatttgtattaatcaaaactattatctgggtgcaagatatgctcattgctacaagattgattatggtttaagtctttttaatagctagaactaggtattatatatatgaatacacgcatatacatttcctttaaaaatagtttcgagttcacattgatatatccaatgtaaatagagttttataggatgtttatggaatctattctgtattacacctgtagttcctttcttccacacttggaatctttcattttcaaggatacaggggctgataaaatggaaagatgctataattactggttaaaatgactcagtaattcacaggggttaaaaactcctttaaaccttaggttgtgtggcaaacaccttacactcgcccactactggagttggcaaacgctttccagtttcagctgctgttttcccaacaacacgtgaatacatgttgcaattttagcactctccatgtctcaggcccgccagacaccttgctgcttcccttctgtttctactgcacagagatgccaatggcatgcaggccttgtagctgttggtgatttgtccccacacgttttttggagttcatgaagatgccttgtcacttagttttgttgtaaatgtgtttatgaatttttttctatttttatttggggatttggggatattcaaatctatgctaggcattattgcctccatctttccagaattccccagctggtattattttcaccaatgaggaaactgagccccaggggaaatgtgatttgcccaagatcacacagccagtgacagcgcagagatgcatgtgaggtcacctgctttcatgcaaggtacagagaagatgcctgatatggaccactccctcctcatcttcctccctatttccactggtcagtgtctttacaggattctggggggtttggtggggggcttttttgtttgttttttgaggtggagtcttgctctgttgtttaggctggagcgcaatggcacgatctcggctcactgcaacctccacctgccgggttcaaacgattctcctgcttctgcctcctgagcagctgggattacaggcacccaccaccacacccagctaatttttgtatttttaggagagatggtgtttcaccatgttggccaggctggtcttgaaatcctggcctcaagtcatcctcctgcctcagcctcccaaagtgctgggattacaggcgtgagccaccgtgcctggtcccatgattctgttattgacaatcaaatgaaactatccatgcaaagagcttatcactgtaccaatgaaagcattcagtgactggtagcagttagtataggattttatggttgatgaaaccaagggttggagagacagataactgttccattgttacacagctggtaagtgacacaggctttagactcaggtctgtctgaccagaacctaacattctttctcccacactagttcttaattcagagcagctttgtctcccagctggtatttggcaatgtctggagatacctttggtttttatcactgtgaatgtggagtgctactgtcatctagtgggtaaagcctaggaatgacattaaacatcctacaggacaacatctctcccatgcccccgaaacaaagacttttccagctccaaatgtcaatagtgctaatgttgagaaattatgccctatactgtggtgccatcctaaataagccttgccaggcagggcacggtggctcactcctgtaatcccagcactttgggaggctgaggcaggcagatcatctgaggtcaggagtttgagactagcctggccaacatggtgaaacccgtctctactaaaaatacaaaaattagccgcgcgtagtggtacacacctgtagccccagctactagggaagctgaggcaggagaatcgctggaacccagggggtacaggttgcacagagtcgagattgtgccactgcactccagcccgggtgacagagtgggactccatctcaaaaaaaaataaaaagaaaataaataaaactaaataagccttaccttagaatcaatactaaggctggtcctaggagattttctgagctcagaatcacaggccctgaacagagacagctcaggcatgtctagcctcctccagcaggtatgcaatgcaatgtcaagatttttttcttcagaggctggatgaaacgaggagagcaagatgtttgaaaccttccaaaccaagacacagggcaagccgccccctggtgatctttctgcttgagagggggtgatcatcaccgataaacagacatttcatgatacaatgtgccagaactctgcacatgccattcttttttttttttgagacagagtctcactctgttgcccgggctggagtgcagtggcatgatctcggcttactgcaacctctgccccccggtacaagcgattctcctgcctcagcctcctgagtagctgggattacaggcgtgtgccaccacacccagcttgtttttttgtgtttttagtagagacagggtttcaccctgttggccaggctggtctcaaactcctagcctcaagtgatccgcccgcctcagcctcccacagtgctggggttacagatgtgagccaccgtgctcgacctgcacatgccgttctatgacatcctcccaaggatcccctctaaacaaaggccatatccccattttatacataaggaaatgagtcttttcaagaggttgttcagactccataaattctgagtgtccaaggcagagaagacagacatcaaataccagctcaaacacttagtcatcatgtgactttgggcaattttttgtccttctctgatcctttttcccaacctgtagaaacagagacagggctacatgacctttaggacaaagtaaaatttgggaccatggtgtcatacaggcttgaattgatacctagctctctctttcatatcttgagcccttaggagactttctctttctgaatattttacattattttattttattattattttttgagatggagtctcgctctgttgcccggcctggagtgcaatggcacaatcttgactgactgcaacctccacctcccgggttcaggtgattctcctgcctcagcctccagagtagctgggattacaggcgcctgccaccatgcctggttaatgtttgtatttttagtagacacgggatttcaccatgttggccaggctggtctcaaactcctgacctcaagtgatccaccactttggcctcccaaattgctgggattacaggcatgagccaccaagcctggcctctttctggattttagtttcctcttctgtaaatgggacaatcctagctcgctgttcacagggtcattgtaaggtgaaattaagatcatacaagcacagtgcctggtatatataattcaaaaagcagaaactctttttgttgtcattgtttatcggagatgttctaatcctgatataatctggttctctaaaatgtaataccaagaggaacaagaaataatggccctcagttgagggaagaggcagggatttctggggcatctctgaatcctctccctgccctgcccttgagaccaagttcttctcctgctggcaacatctaggattgccatctgggctccaggtaccagtagtaggtcctaggtttgggttaaggagaggggtgaatttattccaatacctaggacagcctggttaggacagggtcatccctcaccctttgccacaagagctgccatttggcagggcgcaggagaatggcttgagcccaggcagcctcccaggtggctgggattacaggcctggctaatttttgtatttttagtagagacagggtttcaccaggttggccaggctggtctcgaactcctgaactcaggtgatccacctgccttggcttctcaaagtgctgagattataggcatgagccaccacatccggctgttttggggggttttctttttgagacagagtctcgctctgtcgcccaggctggagggcagtggcatgatctcggctcactgcaacctctgcctcctgggttcaagtgattctcctgcctcaggctcccgcatagttgggtgtgacagccggaagtgggggcctcggattacaggcgtgtgccaccacgcccaactaatttttgtatttttagtagagacagggtttcaccatgttggctggggtggtctcatcatactcctgatctcaagtgatccacctgcttcagcctcccaaagtgctgggattccaggcgtgagccactgcacccggccttaccttacgttttaaaagatctcacagatgtgattaatgtaaggatcttgagatggtaagattatcctggattatctggctgagcccaatgtaatcccaagagtccttataagaagagggaagcaggaggatcagtcagtagtagaggtgacaacagaagccagaggttgaggtgatttgaagaaggggccataagctaaggaatgcaggtggcctctacaaactgtaaaaggaaaggaactgatgcttcctccaaatccccaaaagaatgcagccttgccaacaccttgattttagacttttgacctagagaactgcaagagaatatatctgtgttgtttcaatccatgaagtttgcagtaattccttgtaacagtaacaggaaaataatacatagatttagcaaacaaaacaaaatccaggatgcccagtagtcatatttgaatttcctataaacaacaatttttaaagtataaatgtgtcccaaatgttgcataggacacacttatctgtgtgtatgtgtgtgtgtgtttggaaaggaacatgcttaaatgtttatctgaaattcaaactgtagtgaatgttatatattttgtctgtcaatcttagaagtgatgaaactgagagcaggagtcaaaactcatgattcccaggtcgcctccatactgctgccccctgcccctcaatctggcagaaactgccacgttcttgtggccctcatgggtcacttcccatcttcttgggactcctcttgcccctggggtaggaaaatgaaaagactgtttaaggtcgtttctttaggctcagagttctcctggaccaccagaggttctgcctcagagggacctaggagatttgcctcaaagttgcagttgcacaaaatacttgcgggcggatcttaatggactggggtgggagttagtaaagcctttgtctggagggaacgtaatgaaccccaaagcaggaaaaaagtaattattgaatcaggctccagagcaagaatcaggtttcaggtaaggaaacggaagcacaagaaggaatggggacttgctccaggtcactcagttaatgacagacagatgtcccctggtttggagtctccctttttggagcagctagtcctgatagcagccatagtggggggaagtctagaatgctaatcctgaggtccgggtttgaagccctttactgccttgattgccagtttccctttcctgaaataggggaattgcataaatatgaggagttaatgagatcatggatgttaaacaacaggtacatgttagcatgttcttggaaaatggcagcttctttccttccttctctgagcctcagtttccccatctataagccgggtttgacaagcggctggtgccccagctcctcccagccactccaggtccgcagctcggagctccggcagccaggtggggactgaacaccaacgccgcggggaggcgtcgcacatgcgcgctcctaggcggagccccgcctcccacgccctggatcgtcacttccggcgcgagaggccgggcaggccgggcagggagtgcgggtcggttctgcgtgcgctgccggacgaggctcccgccgccgattgacccgcgctccgcccgtagtcgggccggtgagtgcccgcgagcccatccgtgtgccctgggagctgaggagagggacccctgagagggaaggataaccggaagtggggaccagaggagcgagagaccccaggaaatggggacacctggggagggggtgacagccggaagtgggggcctcggaaggttgtccacgggatatggggtctcgggggctctaggagagatggcttcctgacctctccttgttgagaggaaggggtggaaaggaaagtgatgctccagaaaggatgggctccaggtgggggagatctttggcttcaccgttaccaatggtgtctgcatctcactcatatgtccgcctgtcagctcattcaccagcctgtgactgagtcctgctgagcgctcggcactgctgagtccctggagagtcaacatgaagctccaggtggagggtacagattagaagcccagggtggggctagacgcatccttgctctgcctcaccgggtgtgcccccttgggcgaatcgcttaacctatatcctccgctgatgtgtacagaccactgccatgtgcccggcactgggggtggcagtggacatggcagacaagccctctgccctcgtggaacttagattctaggggacagtcctttttgtcctcctttgtaaaatggcaacagtaatagcgctctcaccaaataacgtgaagattaaatgaggaaatgggtaaagggcttagcaatgcttgatacatggtaaaatgctcaagtatgcattctcttcattccactataatgtaagctttattaggcaaggaattgtattgtttgcgtctgtgttcccagtgcctgtgagcacagtgcctgacatatatggtaggtgatcggtaattatttgataaatgagtgcgtggtgaaactgactctagataaatgcccatagcattggactgtaatttctaaaaaagaaataggaacccagttctgtggaaaactggagggaatcaccctcagggagtttgggaaggattcactgaggtggtgacatggcagctgagcctgagctgtcaagttaggaacaaattagaagaggaaattccaggcagagtgtatcagaagtgcacgagttattccaaggatgatgggttattagtttgttttgactggcatttaatgtgcatcaaggtggggtgcgatggaaaatgaggctggagaggggctttgaggtgaggcttgtaccttgtgaacactgatgtttgatgggattgcaggcatctcttggttacttccatagaaacaaagccatagttgttccattcctcacttagcatacctgtgccaaccagactaaagtcattcaacaaatatttatggagtgcagattatgtgtctaacaccatgttaggcgctgggtttcaggtgatgaacaagacaaacttggatgttgctcacaaattgccaacagacaattgcaacagggtgggagaagtgcgggggaggcacctaacctggctgggggtcagtgaaggctacctactccaggccaccagcatctctcagctggattattgcaatagcctctaaatggtctgcttcagtcctcactcccttagagtccattctcaagacagcagattggtccttttaaaatatatttttatttatttatctatctatctatttatttatttatttatttatttatctgagatagcgtctcgccctgtcgcccaagctggagtgcagtgacatgatctcggctcactgcaacctccgcttcctggtttcaagcgattatcctgcttcaacctcccaagtagctggcactacaggcccgcaccaccatgcctggctaatttttgtatttttagtagagacagggtttcaccatgttggccaggctggtctcgaactcctgacctcaggtgatccatccacttcagcctaccaaagtgttgggattacaggcataagccaccacacacagcccaagaaaaaatttaaaaattagccaggcgtggtgtgtgcctatagtcccagctacctgggaggctgaggcaggaggattgcttgaacttaggagttcgaggttgcagagagctatgattgcgccactgcacttcagcctgggtgacagagcaagaccctgtctctctcttaaacaaaaaagtgcatgagttcaggtcctctaagaagcagacactaggatgaggttagacgtgctagaaatgtagaggcaacccttgcgaaggacagcacctgggaagggagctggagaagtcaggaagagccactggcagtgatgcagatcagctcctgtgaaggaggtttgggcagcaagtctctgactgcagggcagtcccaacaaaggtttggccaggccctcaagcaaacgctgcctgttagaggagtcctatgtctcactaaatcattggctaggagcagtgaggccacagaagggctgtggaaagttctggcttcccctggatagtggatctagagggacagccactggggccctttatcaattacgttttcccagcagatctgaccggcacatattcccgactgccacgataagttacatgggtgtgtagtaaaaaattcaaacagtatagtaaaaatcctctttctcatcttaaatcttcacttgtccagttctgttccaagagataaccattggtaagtttcttatatctctttccagaagttttgtgtgcattcacaagtgtatgtgtatagtttaaaaacgtgattttctgtacactattctgcaacttgcttttttaatatgtcaattcataaagatctgcctacttttcgctttttttgtttgtttgttttgagagggagtcttgctctgtcacccaggtgggagtgcagtcatgatctcggctcactgcaagctctgcctcccgggttcacgccattctcctgcctcagcctccctagtagctgggactacaggcacctgccaccacgcccggctaattttttgtatttttagtagagatggggtttcaccgcgttagcgaggatggtctcgatcgcctgacctcatgagtcgcctgcctcggcctcccaaaatgctgggattacaggcgtgagccaccgcgcccggccccctaattctttttcatgactgactagtaccccattaatatggtaatattacttaaccagtctcccctgataggcagttaagatgtttccaatcttttatcattataatcaatacttgtgaaggccatgtgcatattatgcatatatatacaagtatatgtcctagaaatggaattgctgacccaaagggcatgtaggtttacattctgaagatattgacaaatgccctccaaagaggctgtcaatttatactcccagcagcagcaagcatattagagtacgtttatttttgccaatctgaatctgagttgtttttttttttttttttttttttttttttgagagtcttgctgtggctggagtgcagcagcgccatctcggctcactgcaacctccacgtcccgggttcaagcaattatcctgccttagtctcccaagtagctgagattacaggcactcaccacacctacctaatttttgtatttttagtagagatggggtttcaccatgttagccaggctggtcaggtgatccgcctgccccaacctcccaaagtgctgggattacagcatatacattacagttgttttaattcacatttatttaatgatgaataaggtcgagcacctattaatacatttataaggaaggccctggtgtttattagggagtgtatagtctgctgtagctgctgcctgcctccctggggactaacagcagccggcctggggtcagacttgcgtgtatggtttagatccagttcattgcccccagttgagaaacactgccctgaggttactcggtttttacagaagtgttcctgtcccctacactgtactgccctaggatttgaaataagcacttgttaactttgcttagggcttctctgttggcagggaccttggtagctaatgtccgaagaaagtgactctctgagaaccagcccttctgtggcctcactctctgaaaatgagctgccaccaccacctgagcctccgggctatgtgtgctcactgacagaagacctggtcaccaaagcccgggaagagctgcaggaaaagccggaatggagacttcgagatgtgcaggcccttcgtgacatggtgcggaaggagtaccccaacctgagcacatccctcgacgatgccttcctgctgcgcttcctccgagcccgcaagtttgattacgaccgggccctgcagctcctcgtcaactaccacagctgtagaagaagctggcccgaagtcttcaataacttgaagccatcagccttaaaagatgtccttgcttccgggttcctcaccgtgctgccccacactgaccccaggggctgccatgtcgtctgcatccgcccaggtatctccctagactgttgtggggtgtgtgtgtccagtccttctgcagtgtgtccattcagcaccctgtcctcctttccaagtcccttttttacccctcctttgttatagtcaaggctcttttgattgcagataacacaaacctactcaaaccaacttcagaaaaaagggaggatttagtcgaaggagacaggagtccctcccagaaccagagagctgaaggcgtggcagcttttactagggcctagaaccaagaaccagaatgccaccaggagccaagacagccgttctccctgtctctgcctgacggtctgtgtatccttcagccacacatttctgccttttgcatatcttcttcacactttttctgtgtatggctgtcccgctcctgtgcacgtagttaaatctggcaccctctcagctctcaggtttgcctgaccaccaaattaagttcctcaatgcagattcccaatttctagtggggagcatctggtggggcctaagaatctgcccctggccataggatacaagcatgactgccagggccctctctgagccctctttgtgaataggttgaggtacaggtatcagtgcaagggtgcggactgggcagacacctggaaaggtgcctcctctgtgcctcctccaacctttccttcctttcctctattttgtgaagccactgacaggattcactttggatttgttttttgatcttagcatttcatggcagtgattaggataccttacatttctttgtcatggtggtttacgaatgggggctccctgccactaaaagagcatttagaaatactcccctgccaggcgcagcagctcatacctgtaatccccgcactttgggagggtgagggagaaggattgcttgaggccaggagtttgagaccagcctgggcaacatagtgagaccttgtctctacaaaaaatttaaaaaaaaatgctctttggggagcatttcaacacaatgaccaggggctgccagaactcaagatttctgattcttaggcctgttctcttccatgacaccaaaagcgttattaaactttggaatgttctactccattcctagcctcaacattttccatcagaccagagctgagagaaaaatggaaagtaagatgcaatgttctccccaagtaagccagggaatgagaacacactaatagccctctttcgctcattcatataaacgccctcttgaagggaagtttgatggggagtggacacctccatgcactttcctccgcctttactcattccccaaactctctttggaggctaaaccattctcttcagactttactatgtatgtaccaagaccactgttaatggcttacctgccattttaggtacttgccaaaattagtggtgtttattttaaaataagcaatgcagtgcagattttagggcgccaggagacttagaaaccagtcagcaggtttttctgctgctcctctgtactcaactcataagaatattacaacacagtcagatattacaacactgattgcacctttgcttgtgtagtttcaaccctttgcttgtgagatgaattttttccccatatgtctggagcagatctggacccctttccactgacccagcgttttaggaagaggcatacacagaaaggtttcttctcaattgggtatcagctttgcctttgttaaagctcttttgagacatgtgattgaaagggatgatatccagttacatagaggcagggttaattggcagcaacgttagacagcaagctggcacaatttggggacaaagatctttcacgagaattttgcacatatcaggtcaggtgtggtggctcatgcctgtaatcccagcactttgagaggctaaggcaggtggatcatgaggtcaggagttccagaccagcctagccaacacagtaaacggcccccgcctccccccaacccccaccccctgtctctactgaaaatacaaaaattagctgggcgtggtggcacatgcctgtaatcccaactaccccggaggctgaggcaggagaatcgcttgaacccgggaggcagaggttgcaatgagccgagatcacgccactgcactccagcctgggtgacagggcaagactctgtctcaaaaaaaaaaaaaaaaaaagttttttgcacacatcacatatcccattgttggcaaatgggaagttttatcttttaagaaagaggcacatagattttgctgggattttcttgagaacagtggttaacagtaaaaagtgggcattctcattttttttttcccaaagagaggaaagaatcattaaatacatggggtgtattaaaaaagtatccaccttggaaagaggaggggaacatagcactatgttccatccttacaatacctccgtcaaggtcgtgtatgagtcaagactcagctttttttttgagacagagtctcgctctgttgcccatgttggagtgcagtggcgcgatctcggctcactgtaacctctgcctcctgggttcaagtgattctcctgcctcagcctcccaagtagctgagactacaggtgtgcaccaccatgcccagctaatttttgtattttcagtaaagacagggtttcaccatgttggccaggctggtcttgaactcctgacctccaatgatccacccaccttggcctcccaaagtgttgggattccaggcgtgagccaccacatctggccaaaactcagtctgtgtggcaagtgacagccaactcacgttagctgaaacaaacaaaaaaacctcagttgctcagataactgaggtctagccgtatttccattcaggggcccaaactctggcactggaaagctgtccccaccactgctgtcctcaacaggggcttcactcccaggccagctctcttgcctcatggggcccgtgaatctcagactcaccgcctcaaaactacaagagggaagacagaactctttccaaagggccaggggtcctagaattgagtctccttgactctgcttgacctggcttggatcacacactgtggccagaaggatgtgctgtcagattggccaatcaatccccagtcacttgctcacctctgaagtcaggagtcaagtcagttctatccaaactgcatggctagagtgggaggaggtggttccctaaggaaaatcaggttagtgctatgaagataaggggaaatacatgatggcagaaagcacagatgtccatgaaggtaggcattatcaccctattctacttatgaggacatcggggctcagagtgaggtattatagtaacttgcccaaggtcacatagctagtaacattcaaacctcaggtgtgtctgacttcagagtgcatacttttttttatatttttgagacagggtctcaccctgtcacccaggctggagtacagtggcatgatcactgcagcctcaacctcctgagctcaagagatcctcccacctcagtctcccaagtagtgagactacagccacaccccaccatacctggctagtgtttgtatattttgtagacatggggtttcgccatgttgcctgggctggtcttgaattcctgggcttatgcttaattcctcccacctcggccttccaaagtactgggattacaggcatgagccactgtgcccagccagagctcatgctcttaacctcaacactcaattgtatttccatcacaaaatgtgctgctgtttggagttaagaaaccagctgctgcttattgttccatttactaacctaaataagagtcatggctactagaatatctttcttttccattttgaaacaacagtgatagaaaggagataaatctttgtttgaccacttatttatattaacttctgtaacatactgtcaatctcttatgaccttagacagatggataccaagcaactatccaattactgaaaacatccgagccatatacttgaccttagaaaaactcattcagtctgaagaaacccaggtgaatggaattgtaattcttgcagactacaaaggagtgagtttatcaaaagcatctcactttggcccttttatagccaaaaaggtgattggcatcctccaggtaagacccgtatgtgtcctgcctgtttcgtggtggctctggctttccccagggcctgtccatttactgtgggtctcacatgatacacaaactgcacatcccacacctgcaatctgaaaaacacaaaagcattatgggaagaaatttaaaagtcctatttaccacttgttctcatcagtctctcaagtactctctggagtaggtacttcagtaagacaagagtccaaaaaactagagaatttgcttgttgccttttcttggtctggaaggcagaggaagaattctcataacaaacaaaactggctgggcgcggtggctcacgcctgtaatccaattctttgggaggccgaggcaggtggatcacttgaggtcaggagtttgagaccagcctggccaacatggtaaaaccccatctctaccaaaaatacgaaaattagctgggcatggtggcaggcacctgtaatcccagctacttgggaggctgaggcaggagaatcatttgaacccaggaggcggaggttgcagtgagctgagatcgcgccattgcactccagcctgggtgagaacagcaaaactctgtctcagaaaacaaacaaacaaaaaacctaagaaattatgcttctgcgtaaggtgctggagcccctcctgccctctgtggacctgagggatatggtgttctgttgggctgtattttggtcagatgcttcacacctcatgttctgtgtttcagaacatgagtcactggggactgtggtgctccctccatatctgcaccgtgtttaacagcttgcacagtgcttttacagtcatcagggcctattcagtccctcagcgaatcctctgagataggcaaggcaaaaactatttttcctttttgatagatgggaagatggagacctagagaaaatatagcctgtcacagctgtgacaggttttgattacttgttcattctgacccaccacgtggggtgttttcccttgtaaactatggggcaccggtggtatagtagctcttctcactgattccacaaatgtttcagcccctgtggtgcaccaggtttattatttaaataaatcagtgcacatttggacattatcaaacatttggattctggctttgagccaaccctggctttccttcgctggcactccttttgatgcctcctcctgaataccttgtagattcaagtgtcaggatcaagagtgtggatcagtgttagtaccgtaagatcatctggagaggagaaaaaattaagtaagtttgggaaatgctgtatagcatgtccctttcttgtgaatttcactgtaagaatttacatgttaaaggctctgaacaggaatgcagttaaggaaactcacttgattatgcttagtggactacgtttctcaaactcatttgcctgctgtggagccctgttttatataacctctaatagcctgagaaatatactttgggcaacactgatctggaaggtctggtatttgccagatctgtccctgtagactcagactgttttctgctgtaagagcagcagctcttcatatgtttgcctctcttcttttttttttgagatggagtccaggctgtcatccaggctggagtacagtgacacgattttggctcactgcaacctccacctccagggttcaagcagttctccagcctcagcctctccaagtagctgggattatagacacgtgccaccatgcccagctaatttttgtatttttagtggagatgggatttcaccatgttggccaggctggtctcgaactcctgacctcaagtgatccgcccacctcggcctcccaaactgctgggattacaggcatgagccactacacccagcctctgtttgcctctcttctaacccagttttgggtcccaggaaagactttccctgaggtccgtcttcctagttaggccccacgtggactgtcattgaggaggccataaggatcagatcagactgatgttggggctgaaagtgaagatttaacttgggggaggaaggtgtggaaagattctccagatgttctaaacccctttgcctttcccacacaggatggtttccccattcggataaaagcagtccatgtggtgaatgaacctcgaatatttaaaggcatttttgccatcataaaaccatttctaaaggagaaaatagcaaacagagtaagtgatgatcctattgacttcagatttttcttttcctctgttgatttatttgtgacatctggtacttgtttattatttttgccctggaacaactaatttggaaaagtacagagttacagataaaataaatgaacagtcccttttgtgaggagaagatggaagagtaaatgaacaagaatttaatatttgccagtagagagagcagaaccaggatttttatcataagagcctccctgggcagtatagcaagactcatctctaaaaaaattttttaaattaggtgggtgtgcctggggcacagtggctcacgcctgtaatcccagcactttgggaggccgaggtggatggatcacttgaggtcaggagttcgagaccagcctggccaacatggtgaaaccccgactctactaaaaatacaaaaaattagccaggcatggtggcacatgcctgtaattgcagctacttgggaggctgagggaggagaatcacttgaatccgggaggcggaggttgcagtgagccaagatcatgccgctgcactccagcttgggcaacagtgagactgtctcaaaaaaaaaaaaaaattaggtgggtgtggtggcacatgtctgtagtctccactactcaggaggctgaggtgggaggactgcttgagctcaggaattcaaggctgccatgggcttgaacaatgggctatggtcttgccactgtgttccagcctgggtaacagagcagaacactgtctctaaaataaattttttttaagttatggtcattagaactgtggggtttaaaaatgctacttaagcctttccatttgcctaatatgttgtcccactgtacagtttgtggagcaattcaaggtttacgagctatgtgagtttttagcttacctcttatttaagaagggataaatagcactttgtcttcctttctgacccagaagagccaattccctcttcagcctttcccagtcccactgattgaaatgggatgggtggtatttttctccttccctaggcctaggaaggtcactgcaaagactgggccctgaattttacttgctttttctttttttgagacggagtctcgctccgtcacccaggctggagtgcagtggtgcgatctcagctcactgcaacccctacctcccgggttcaagcagttctcctgcctcagcctccccagtagctgggattacaggcacgtgccaccacgcacagctaatttttgtatttttagtagagataggcttttaccatgttggccaggctggtctcaaactcctgacctcaggtgatccacccgccttggcctccgaaagtgctgggattacaggcgtgagccaccgcactgggcccttgctttttcaaagtaacatatatagatggaaaatctcaaggaggtaagggagggaacttgaaatccagctccagattcctaggctctttccctgaagattttgattcatcagctcagggatctgtgctttaaaatccccttaggaaattctgatgcacagctagatttgcaaaccactaacttagtggcttccctgactgtatgtgaacccatgtgggtccctaaagattctgtttggaactttcaccaaagcagcctttggacaggtcttttacatctgtgaaatgcgctgatttggggcccacaatgttcttcgtttgttccttcataggttcctttattcagaaatatctattgatcaactctatgtacaagcatgttctagatgaacaaaacagaccaaaacccctgcccctaggaaaattatattctaaagggagccacagtgaattatctagtattagaatgtggtaagtgctacagagaaaaataaagcagagaaaagtatagcgtgtgtgaggtgggaagggttgcagtattcaactgagtggttagagatggcagccttgagaagctgacatttgagcaaagacaagaagtgagagagtgagccatctaggtatctgggaggccagcaaggacacaaccctgacgtgggagcctgtccggcatgctgggagagcagctaggctggcgcagctgggtcaagactggaggggcaggtggtgagaggagcactcagagaagtaatgaggctagattatgatgggcctcagagtctgaggtgggagtgctggaaggctgtacatagaggcacgactgtgattctgagtttcactgaaaagaacttagattgcagagggacaagagtgggagcagggagaccagataggaggccactggaggaatccagggagaagcgatgtggctgctgccattaattgaatagtgtggtggtgaggcggctggatcctggatatattctgaagctccagccaacaggatgtatggtataaggaaaagagaattaaggatactccaggctttctgggctgaaaaagtaagggtagagttgccattaacatttcctttcttcattcaacagatatttatttgagcacctaccatggaggagatttctgcattcctgattaacctaaggacatgtgtgttttcatttcattcccttttagttcttcctccatgggtctgacttgaactctctccacacaaaccttccaagaagcatcctccccaaggagtatgggggcacggctggggagctggacactgccacctggaacgcggtactgctggcttcagaagacgattttgtgaaagagttctgccaacctgttcctgcctgtgacagcatcctgggccagacgctgctgcccgagggcctgacctcagatgcacagtgtgacgactccttgcgagctgtgaagtcacagctgtactcctgctactagcccgtcccccagggtcaccatctttaattcttttccttcttttctttggagaggcacaaggagaatttaagggtccatggattcagtcttgctccttgtaattaaactgcaggatggaggaacagcctgagatatgagcatgagcccattttggggtaagcctttggttactttaattactccatggaagacatggaaaatgtccccactgattcttaaacatttggaatcccagtctgcaactattaatctggaggctatatctattttgttttgctttttggttggggggtggtgatctggttcttacacatcttggaagcaagaacaatcaggaccaaagtcactttgatcccacttttccaggagaaaaaccacctgtttggccagtgagaactacttgtatgaaataatttggccaaaccttcagtgtgaccaaatgtgagactgggagtttgtgtttttcacaggaaccctaagtatagacctctgctgctcatcaggaaacttactggagatgaaggccccagctgttgtcaccgggtttggaaagcaccttaactgaatcatgtaagcatcaggacataagcagcactttgtggtcaaatgtggaagccggagacttcaaagcacctctgggacccactggttgaagtttgcaatagaaacttaagttttcccaaatccataaagccttagccctggttctcaatagaatcagggacctagcaggaaatgattttactcaacctaaaatgctggatcccaggcccgtgtagctataagaattctggcctggatcccaggtgtacaactatggacaagatatgggcctctactttctcctctataaaatgaggctggatgaaatgtcagctagggccattttggctgctgaggctctgggatttggtttagttactgaatgttagattttctgcctagaaagataactatctagatacaagtggttggatcctgtttttgtttgtggtacatgtgtctttccaagagagatgtgtcaccaattagccctgcctttaaagaaactattatgtgtattcctgggactcactgacaccaattttctttttatagtgatggttcaattttgaaaagatggcttttgtgaggccaggttaaggtgaccaggatcttgtatgatgaattccttccatccctgagactctggtactatattgtaaacctggctacagtagttaattacttgagattctttaattttggtctctgagctgggcgtggtggttcatgcctgtaatcccagcactttgggaggccaaggtgtgcggatcacaaggtcaggagttcgagacccgcctggccaagatggtgaaaccccatctctactaaaaatacaaaaattagctgggcgtggtggcgggctcctgtagtcccagctactcgggaggctgaggcagaagaatcacgtgaacccaggaggcagaagtggcagtgagccaagatcgcaccactgcactccagcctgggcgacagagcaagactctgcctcaaaaaaaaaaaaaaaaaaaaaaaatttttttttttttggtctctggaaatgaacacaagggcaggttattcctgggtcacttctgggcccccctgccctcccagccccacttgagtttctctctctggtgtgggtgaaccagtcagcctgaatgttctgcatttcagcactttagaacctccctgtgaagattttagccttagcccaaacatcaaattagacggttcacatgatggtttttgacctatttcctttctaatgtattccacatgatcatggtgttaaatagtgaaaagtactgtgttgtgtgtgcaccttctccgtgcatttattagactaaccagtcaagcagacagctcagttagggagaaaacaatactctgaaatttgaaggccaatctgttgttactaagctgtttatctctattgcctttttaaatgtctggataagttgttggtggaaattaagttacttaacctcattaataccaattctagagaaagttcttttcaccatggatagtaaccctggatcctctacggtactggctgagctggaagtgccaaaaagcactcctggctgcttctggttccatctgatgatgatgtgacacacactgctgaaaaggcccaagcagggcaagtgggatggctgaaggagggaaggagggggttcagaacccactggcctggatgggagaactgggtggaggcttccccaagagggaagacagataaacaaaacaaaacaaaaactgggtaaagaggaatgaatcactcagccctgatgtttcaattctacactgcattcctggccagtcgcatttgttttaatgcaggcatggccacagctctcctagagaattatctcaaagaccagaagggacctggagaggcctatttcttaggtttttccagttggacaaggaaggagtggtttcactcagcttctagaaggagttggagcctaagtttatctgcctccgggagctgcttgctttgttttggctccgaagaggtatcagatagttttgacacctcaggaaacttgaaccaagctgtgaaaccaagacctccctgcgtgaaaatcaaggtggtctccttgtggcttcaccaggatgtttgtgtcaggctgtctcagcagggtggggaatgaccagccagggagcacagtgagccttactcagcactggggagcgcactggtgaggcaaacccatgaacctcaagaactgggagtatgttccttcagggagaagttctggcccattgcacaaacacttggaaattaacttttccctaaattcaagatagtgtggtgtcggaaggaaatgggacagtaaattaggagacgcgggctccacctttaccttactacgtggcctttgatgagctggcttaacatccctgagtgattccatgatagagatctatactccaaactttattcctggtatctagttggcttcactgccacagacactgtactctctctttttagaagtttttttccttttttttccccctcaattggcttatttagtaaatttaggtctgaatgaattggtacctaaaagcttccaaatctatacatttcagaatatgggaattttcttcctcttcttcccccatatcccaacatggaattctggaaaactgtgcctcttcccctgttctgccttcatgggggagagactggatgaaatctacaaaaacagccaaaagtgccaccctggcttcatgtcttgaatttctaacttgctcttggcaaaggtcgctttattttttaatttttttccttgcattttcttttttattctattgctgctgcaaaaattaaggcaaaagtagctttcgatctttcatatttcatcctggtttcacaaggagtcacttatcttaggaggtctgtaagtcaggttacaaggccgggagcggtggctcacacctgtaatcccaacactttgagcggctgaggtgggtgtatcacctgaagtccggagtttgagaccagcctggccaacatggtgaaaccccgtctctactaaaaatacaaaaaattggctgggcatggtggtgggtgcctgtaatcccagctacttgggaagctgaagcaggagaatcacttaaacccaggtggcggaggttgcagtgagccgacatcgcgccattgcactccagcctgggtgacgagtgaaactccatctcaaaaataaaaattgaaaaatcaggttacaaaacaccatttttcccgaaataagacaataagaggcttttctctgaattcctttatattgagcctttcagaattctccctgggtgggcaatttctttaaatagtatttgaccctcagatcaatcctgggaatttttttcatttgggtagcaaaagctagagtattgctgtggcgattataatacttttaaaaagttttaccattttaaagttgccaacatttaattaaggttttcctttgaagcctcctttaatttagggagtaaaatgttagctaaaccaattatatactatatactatacactgtatctcctgtggccatgagaggtgtggctataccgaacagaaacatgcctactgttcaggaaagatgtcagttctggtaacacctctctgtattgggatctgttaattttgtaaatctaaattcttctgctcttggccaggtgcagtagttcatgccctgtaatcctagaactttgggaggctgaagggggggcggatcatttgaggtcaggagtttgagaccagcctggccaacatggtgaaaccccatctctactaaaaagtacaaaaattagctgggtgtggtggtgcgtgcctgtaatcccaactacttgggaggctgaggcaggagaatcgcttgaacctgggaggcagcggttgcagtaagccaagactatgccactgcactcccgcctgggtgacaaagcaatattctgtgtcaaataaataaattcattcttctgctctcctgacttagagaaatggtttgcttaaaatgctagtaacaaacatcacagtcaacaggagcttgcttcatgcgaaggatcaatgtgatttgtggatggagatgatagtgatgaaattcctgtttcatggggctgtttttcttttcatctcactgggcagcaggtttagtgaggcagtgagatgctgctgctgtggattcttgtagctatgcctcggcttcttggcatatcaggtaggaacctgttacaagtgaaatacttgaaacctctctgaccaagagcctctgatggagtgggaggtgagctaattctctgaccagcttggggcactgtttcagccactggtcacattccttgcttcaaactgaaattcagtttggctttgagtatagggatacatggtggattcatgtacttcagtgtttgttttgaccaaagtttatttttctagtgcattttctaagtcaaagtggtgaaaatatgtaataattttagtatgcatgactcagtctgaaacaataaaaatctctgaaaaatgtgcatggggttcttttgtgatgatgacagtttggataaaggttccaaggttcattattcacagcccgggtagaccacctcctctgcaggtgagggagggaggggcactgtgataggacagtgcattctgtagatgcgctggctgcctctgaagatcatacacaattagactgctgcagtatggagaggagaatgcagctagctacacagagcagtagaggtgatatgcaaatttttacattcttgaggcccagctatacttcttggactggccttgagtctttccagtgatagccagcgatttcctcaatgtgcgcatgtgggctgggcacacatgtgttaaggacactcataaataatgtattttaaccttcagctacccttaatgaagctgcattactgttcctgttggcaaaatgtagcttgcccagtgacacacaactagccaaatactaaggatgggattcaaacccaggaagtatgacaagcccactgttttctcctgatggctggagacaaataacgagtccccagatagaagagagagagaaggcaggactctttcatagagtaagaaagaaccagaaattgactttttaactggcttcttgaaaatacaagcagtggttgttaacctctctgaaacccaagttgtaacaacattttattccagaagtaagcccagactccttgaggggtaactggagcacggcttgcccaactatggtcccaggcctgctaagctgtttctatgtcccctgtttatttggtactctgtgccccagagtagacaaaaactaggtccccatggtagatctggtgacttgatgagtcagttgagaaatactctaacacaggaggtacacttttgatgatgcaacaggttaagtacttatattgcagcataaccaccccttcaggtcagcctttcctgaggaaattgtggaacttaagttcagtctgtttctcacatatagaaaaatgaagctaactgttaaaatccttttctctcacagcagtcttatgaggcccttttccatgagtcagtattttcttgatgccccctgccccctccttacacagtactggtttggtacccatacactcaatggcaataaagtttcacattatcgcatttaaagggtaagtaataagaccctttagggtaccactcttctggggaaaacgtttttaacctaatattcatgctttttcctgagtaggtgccagccactagggatagctgacctagtaaaagacatgagtcacttgccttcaggtgactactaacttgtctttgtcagtgatgggtagaggagcaaacactctgtgcctgagagtagacaaaaactaggttcccatggtagatctggtgagttggtgatgagtcattagtgagccagatgactcccctacatgtctctaataaatcctgtctcttatattcttatggcccaagagacactgaggtctaattgaaaaaagaactcttaagccaagccctgggtttctctgtttcacctcttactgagtaaccataggcaagtcacgaacttctctaagcctcaaactgatacgtaaaaggaaggagggagggaaataatcaccaccttacaggcatgtggatactgtctgtttaatgcttggtacacctacccatctatgtggtttctattattcttcttcacctgagaacataggcatggtgtggcttgagtcatccagcagtaattaggacatcactgagttgggtgcctaggtaacaggacggacagaccaacacaacaggagtaaagagatgaacagcagcttccattaataagcataagcctactatctgttatcaatctgcacagatcaaatgcacaactcattatgtgaatactcactttagcctgaatgtgtaaaaacagccaggtgcagtggctcccgcctgtaatcccaacactttgggaggctgaggcaggtggatcacctgaggccaggagttcgggaccagcctggccaacatggtgaaatcccatctctactaaaaacacaaaaattagccaggtgtggtggcgcgcacctatagtcccagctactcaggagactgaggcaggagaattgcttgaacatgggaggtggaggttgcagtgagccaagatggcaccactgcactccagcctgggcaacagagcaaaactctgtctaaaaaaagaaaaaagaaccagttacagatttctttgttccttctccattcctcacttggctagccaaaaagaaaaagaacaaaacctctatactgagaaccaggtccatggctactctttggcaggcagtttctttgattaccaagagaaagttttacttcccaaccagataacccgcaagaccaacctagaaaataaaggagtccagcatggacctagaagctttctcccggctttaacgaggtaaaagtggcagccactgctattgcctttgatgagttcctagagcatgtccctgatctgaaagccagggccccaacccgcattccccaaggctaggcaagccctttcatagtgatgaaacataaaggtactcatctggaatgaaaggccaccctgagatctgatgactcaaaatactcccctgctttaaatgatgatcctggccttattcagaatgctgtcttactcatgcttgtatataattcagcattcacatgtataattcacttgagtcttgattagactactggttttcctactaagaggcagacttcactacttcttaaggtaggaccaagcaaagcagggacactgcctcccgacttttaaagagcatttgttacttcaaattaatatcagttatcatcatgagaaaaaaataaaaactttattggactttgttacatttattttacagtttagtattgtttgtattttgaattacattaaggcggaggatggggcactgtaatgtttttgaagtttaggacctttaaagctcttaagctgactccgctactgtaaagaaaagcagggtatctgcttcacactggcaaaataaggggctacatttccccatctgaccctcaaatcccttgaaacgctataccctgacataaaccactggtttaaaagacaatgattccaataatttatatcaagtcctgcttccctaccccacacctccaccctaactgagcctgtcccctctgtgttcctctgtctaattctgtaacaaaatctgaaatccagcctccatcagattctggctagatatctctgacctttgaatattgtcttattttagcccataatgagatcagcagctactgtcagtgctatgtcagtgctaaaaatgggttacactttgcaaaataactttattctttaacaatcttgtacactaggcaccaacactgaggctcagctgcctgtggtcataaatcaaatagtacgtactcaacaaataatagctgacaagtttgatagccagaaaacggcaaagctgggatgcaaacccaagcagtctgactcccaagcctcttaaccattcttaagagaccacctacctccattcttcttcgaacacatgtttttcctgtttgccacctgaatacgtggaaccaccatccacccagctggttaaaccagaatcactcagaaatctacctctccttcatattattcataactgccagtgttaaaattctaattgctggccaggcacggtggctcatgccagtaatcctagaactttgggaggccgcggcaggtggatcacgaggtcaggagatcgagaccatcctggctaacatggtgaaaccctgtctctactaaaaatacaaaaaaaattagccaggcgtggtggtgggtgcctgtagtcccagctactagggaggctgaggcgggagaatggcgtgaacccgggaggcggagcctgcagtgagcggagatcgcaccattgcactccagcctgggcgacagagcaagactccgtctcaaaaaaaaaaattaaaattgaaaaaaaaaaattctaattgctaagtagccctcacctgtcaatttctccccgtccctacgattccacttctctatttcacatctcatatggactgcacctggtctcatctctctaaatccattctctatatatcagcccaagtgactgaagataaaatttgttcatgacactatgaatatgttttcagccaccctcaacataaggtccaaactctttactgaggttgataaagccctttaaaattcagtccctgactacatttccccattccagctttactgaactttttttccccatcttcctgcctttaacatgcagttttatctactccagcaatgtcgtctcattttcccatctctctcttagctaacttctaagagttcttggcttaaatatcattttctccagaaagcctaccattacaccaaatacctctcctttgagttctctccaattcctaaaccacagcactaattcacattataaccacctgtcagctcatttgctctcttctctaagctattaaagtccaagacggcagagcctctatcatgtttaacactgtaccccaaaacctacagggtctagtacagaatagacagtaaatctttgttgaaagaactcttttattctacctttttgcacaccacctctcatgaaaatggttcttgacaatgccttccgtctctcatctaccaagtgtcttacctagagaaggtatttaggacttttgaataaattcaagactttgctcactagtcagaccgtaatttttagaaggaataggagcatcctgactagaagcgtgataaaacctggctatccagaaaataaagaatggctgctaactataaaagctgttggaagaaagggccttaaaatcttaaaagtctttgtattttaaccaaataccttcatagtgcaaatatgataaattcacatgcattttacttttacatactcataacaagatagtaacacagactaaagctgcagtgttttcccaagtgaatcttcattttaaccaaactcacaaagcatttatggaaattaatacatctggcaaagcaccagacttgaatcaagcagtctcaatgctacagtgtaaaaaaagtaaattaaaaaactcaagatgtagaagcagtagccatatcagcaaccattcttctagggaagggacccacatatacgatccttccccaagaactttgatgctaccccgctgaagagtttaagcacaaaacacagtgcttgtatcatataagtaaggactttcatagaggaaaactgtaatataaatgcatttttttttttttgcttttaaaggatactgcaatataaatatattaagcatggcctcaaatatccaacattttcctatcttacattttaaaccaaagttaaaagaacctacaggctttataaagaactctcttcacagcacagctgtagttcactttaaacaaaaaatgttccctttgtgctatatccttagaagtaaacataatatacagataaatgagaagtttcgattctgcatcaagcattattcaatctcaccttctgatataaacctgcatacagtcaaacttgcaaagcattcacttaatattttagttgaaacaaacttaaaaggtatatgggttttcggtgaaggagacctttgtgagttccagtggtgtccttggcactcagaggttcagctgaagtcccgactggtgaggacaagtggagccacaagggtccagacgtaaagcaggaggcagacccagctggagctgatcttgacccacacagctggccacttgctggtcatgctctgaaactttgcatcagggctaagaaaacaagagagagtcaggtagaaaagcctggtctacctgacttctatcagcctcctgcagccccccagccaaggccaagaaattctccagtgaaacttggctggcactaccccccagtagggttgaaggggaccagaggaagctgctatttttagttcttatgaccaagaactaaacagctcattgactctgcctctcaaatgacttttcttcttgccagcatgaaagaccctatcagggcaaagttctttaaatgttcctagttactggcaaaggtctagattgagatagcctccctgaaactttccttccttagtacattattacgggaaccagaatgctctgacatggccatctctatacacagaaaattagtgaacaaagatgggtcagattgctttatgtcatgattttctctctcaattaactcaactctgtaagagctcccaatgatttgcattgcaaagaattccaatgggttttaaatgctagaggggataaagtcaagagtatttaacccaacttcattatatgggtaagagcaagggttctgaggtcaggacaatggatgagattttataggccatccaagggttttatggtcttctgtctgttttgtctgtgtctcctacctgtaccagctggtcagggtcatcatgatgtacaaggaagccaagcagagcatgaggtggaataaggagtagctatactgcactccctctttctcgttgtccacagcccgccgaggctgtccatcttcttcatcactggcaccactggtagttgtatcaccaaggatgacgctgtcactccctgacagggtcagcttgtctacttggctattagtggaagtgcggatgctggaaagtgatcccaaggaagacaaatcagaaaggggccatgacaatgaactgctgccactggcctgtatacaagacacttactgctgagctgttcctactttggagactgaaagctttctgaagatcctgcttaaagttctgaactgctgcctgtcatcataagactgacgtcactgtcatcagttactacttgatgtgatggcttaattgcttaggagtttcataaaacacactatgctctctgtgtctgtttccgtgacttcacaagtgccgcttctatgattggaaggtaccacgtgccaacctccttccaactaacttactcatccttcacttctctgacttgctgtcatgtcctctggaaggccttccctgacatcacccctcactggctaggttacaagacactcctccgacttcccacagcttcctaggcttccttctgccactgcacatatcactcctatcttccttgctattcaaagaatgccttaacagtgaccttagtctatgtaattctagcactacagatgttcactaaaagtttgttaaatgactgaataaaaatgtaaatacaaaaacaggacaaaaattacatgctcgtttcaacagacacagaaaaaacatctcacaaatccaatacctttccatgataaaaacagtcaaagtagaacttcctcaggctgacaaaaggaacaaaaaacccagagctaacatcatacttaacagtgaaagactaaaaactttccccctgagatcaggaacaagacaaggatcctactctcaccatttctatccaacaatgtagtaaaattctagccagagcaaatagaagagataaatggtatccagactagaaaagaagtaaaactatctctatctgtagatgacttcatcttgtttataggaaatcctatggaatacatacacatgcaaactattagaaccaataaataagttcaccaaagttgcaggatacaagatcaatatatagaaatcaggactgggtgtggtggctcacgcctataatcccaactacttgagaggctgaggtgggaggatcgccagaggacaggagctcaagactggccagtgcaacacagcaagactgttcctaaaaagattaaaaattagctgggcatgatggtgtgtgcctgtagtttcagctactcaggaggctgaggtgggaggatcacttgagaccaggagcttgaggctgtagtgagctatgatcacaccactgcattccagcctggatgacagagcaacacttcttctcttcaaaaaaaaaaaaaaaaaaacacaaaaatcaattgtatttctttttgagatgaggtctcactctgtcacccaggtggactgtagtagtacaatcacagctcactgcagacttgacctcctgggctcaattggtcctcccacctccccaagtagctgggactacagattgcaccaccacacctggctaatttttatagagacgggctcttactatcttgctctgactggtctcaaactcctggatgcaagcgatcctcccacctcagcctcctaacgtgtgggaaatacaggcatgagccaccatgcctcgtcaccaatcatatctctatacactagcaataaacaacccaaaagttaagctaagaaaacatacattcatttataataccatcgaaaagaataaaatacttagaattgtatttagaataaaacacttaaaaacaaaataagtttaagatttgtatactaataactaactataaaccactgaaagaaattaaagacctaaataaatggtttaagtaaagaagacttcagtaaggtatcttcatggtcacagactggaagccttaatattgctgagatgacaatactccccaatttggtctatacagattcaactcaatccctataaaaatcccagctacatatttttttgcagaaattgacaagctgatcctgaaattcacatgggaatgcaaaggacccataactgccaaaacaattttgaaaaagaacaaatttggaggactcatacttcctaatttcaaaacttactacaggctgggcatggtggctcacacctgtaatcccagcactttgggaggctgagaaaggaggatcacctgaggtcaggagttcgagaccagcctagccaacatggtgaaacactgtctctactaaaaatacaaaaattagccaggcatagtggcaggtgcctgtaatctcagctacttgggagcctgaggcagaagaactgcttgaacccaggaggtggagattgcagtgagctgagatcctgccactgcactccagcctaggtgacagagcaagacactgtctcaaaaaaatatatatgtacacagctctgtaactgaagcaagtaaagaacttttcattaaagagagtgaagtttttaaatttctcatgctgctttttgaaagcaaaacagcttcttcactttattatcaacctccatgaaaatcttgttctaagtaccttttaacttacctagaatacaagaggcagagaacaaagacaaacagtccaataaaattatctgaatccagtaaagacccactctttgatggtggagtaggggtagggaccacagcagttgaatttccaggagccagggttggtgcagttatgcgtgtaataaagctcatcaggttgggattgcaggaacgatctgaaaatgagaaaatttgtattatccttggttacagctcatcttgttccaagaaagaacttgaggagttccctacatatcattcagtcatgatgtgaaacatgggaatgctttacttaaaaaatctgaaacttagcagtcagtagtaacacgtttggtcacaatcaatgacagaattaggaaaaaaaaagaaaacaacaacagaatctgtcaaatttcataaacatcattattgattttattggttttgtagtttgacaaatctttttaattctttaagtgtcaaggttttaagcacagaagtttatctctattttggtttttacatagttacttaagaacaaaatataagttatcattggtggaaggggggtctgcattgttttcctttaaaagaagcccatagaatatcctactgagaaacaatcctataataactacaaaaggagatttcctacagctgtttcttctacagcctgtgacatcaaactaaaattcagtcacaacaaagggccaaagcccttgaccacagctcttaactagtttgactcagcctaggttaggtaaagcctagaccatctaaaggactctgaccctttagactgtcagttataaatagctatcaatagatgtggggactaaaatgtgaaaggtaaatacctacaaacctacagtgaacactgtacgtttaagttttgtttgcttgtttcacatttgctctagctctagtttttgtaccaactatgtaaaggctgatttcctactttctttttatcaaatgaatgtgttattgacattcccttaccaggttcattggacatggctgaccaggtgaggtacatagtgtagagggtgatgagggaggactgcaagaggccggagcgaggctggtgttcctatggaatcaaaaggaaaacagtggcacagggactgccaagggctgactttccaaaatgcagtgcacttctctggagttaattcaactatcagtaactgagaactttcggattcttcttgagagttgaaaggtgacaagtaaccttctgttcagttagctcgcaaaagaacccagaaagaccaagcaagtactactggttctcaacgcatttcacaatcctagaaattcctgtgcatcacacaaggactttgattttccactcccttggtgtagtgaaaagatctaagatcagctctgcaactaattagtagctgggagaggcctatcacttctttgagacttctgttttctcacttttaaaaggaaaggtgatgtctagatagaattttcatatttcatatctataactccatgaatttttttaaacggtttttttttcttttttttctgagacggagtctcgcttttgtcaccccggctggagtgcagtggtgcgatctcagctcactgcaacctcctcctgggttcaaatttctccttgcctcagcctcctgagtagctgggattacagtgcccgccaccacacccggctaatttttgtacttttagtagagatggggtttcgtcatgttggccaagctggtcttgaactcctgacctcaggtgatctgcccgccttggcctcccaaagtgctgggattacaggcatgagccatcacgccaagctggagtttcgctcttattgcccaggctggagtgcaatggcgcaatctcagctcactgctacctccgcctccagggttcaggctattctcctgcccctcagcctgccaagtagctgggattacaggtgtgcgcccccacgcctagctaattttgtatttttagtagagatgacgtttcaccatgttggtcaggctggtcttgaactcctgacctcaagtgatccacccgccttggcctcccaaagtgctgggattacaggcgttaagccaccacacccagcctaaactatggtatttagaactcaagagcatgagttttgttttgaaatattaaaatcaattatttttcagtttaattcccctaaaatatcttggctaatgactcataagaatcattcccagccacatgcggtggctcacaactgtaaaaccagcactttgggaggctgagatgggtggatcacctgaggtcaggagttcgagaccagccttgccaacatggtgaaaccccgtctcaactaaaaatacaaaaattagccgggcatggtggcaggcgcctggccaaggctggagaatcactggaacccaggaggtggaggttgtagtgagctgagattgcaccatcgcactccagcctaggggacaagagtgagactttgtctcaaaaaaaaaaaaaaaaaaagactcattcccggccaggcgtggtggctcacgcctgtaatcccagcaccttgggaggccgaggcgggtggatcacgaggtcaagagttcagcctggccaagatggtgaaaccctatctctaccaaaaatacaaaaactggccaggcccggtggtggctgcctgtgatcccagctactcgggaggctgaggcagagaactgcttgaacccaggaggcagaggttgcagtgagccgagattgtgccactgcactccagcctggttgacagagcgagactccatctcaaaaaaaaaaaaaaaaaaaaaaaaaagcactataaattttcaagttacctgggtttttttttaatgatagtgaaattcatttaattatgatataggcatgaaatagaattatgaagactttataatatggaaaaatgttcaagtggataaacttagacataaattcataagaaagggtacctagattttaagcttagaattaaaaacctttcacaggagaaagaagtagtaaacaatcatacctgaatttttgggtggatcgatataatagaagccacaacgcaaaggatcaggttaatactgatgaagaacttgttttctgtgcagccatctggtttggtgtaatatgtatagagcagcccgacacagatgattgacaggatataaaaggcgcttgtgaaagacagtaaagctggagaaagggaaaccaatatgaatgaccacaactataataaactaataatgaaggccaattttcttccactccatataaaaatgaggagacattatgtcacttttctggggtaatttacagtaaaattacagaggtctcaaggttaaagtatcaagattgtattcaattggcttgatgttaaattccaaaatccaccaagcaactgaattcacttcctgaattacctgatttgatttcatgggttgattaccagacatttgatcattccagctagagtttactgctacctatatgttaattaatgtgtattgtgagcttttcttaggaacctaaatgattcctttaccctcaaaatgacccagttcacagcaagctccatgccaggatggtgttagaggaaaacagaatacacacactggtatctttttatgacagttttttcctctgcagccattggctatctaaatccatttcccatcacaaacaataagactgtccctgaactggaaaagtggctcatttgctattttttaatatctaaagtaatggtcttttccattcacactaaaaatcaacaattagctgtgttggctgaacatggtggctcatgcctgtaatcccagcactttgggaggccaaggtggctggattgcttgagcctgagttccagaccagcccaggcaacatggccaaaccctgtctctacaaaaaatacaaaaatcagccaggcatggtggcataaggctgtagccccagctacttgggaagctgaggcagggggattgcttgagcccaagacatagaggttgcagtgagccgagatggtgccactgcactccagcctggacaacagaacaaaaccccatctcaaacaacaaacaaaacaattagctgtgtagctctgaaaattagaaaacatgaaacagcacatacagtacactcagaccaactgcaagaatgatgagctcagctaacttgtattcaagtcaaagcccagattaagaaaactagtttctacttatctcaatgaattttgcatgtctaaaattaaatgatgtacattaagttactagcacacttaatgttttcacctctgaatatacaagatttttctacacttagttactgtaaagtatgaccaatttgcaactcaataaattcttctagagttgtatgatccaaaatgaattaaagaaaataacagccgggtgtggtggctcacgcctgcaatcctaacactttgggagggcaaggcaggtggatcgattgagtccaggagttccggcaacatggcaaaaccctgtctctacaaaaaacacaaaaattagccggtcgtggtggtgtaggcgtggtagtgtgggtgtggtggtgtgcacctgtagtcccagctacttgggaggctgaggtggatagcttgagccaggaaggcagaggttgcagtgagccatgattgtgccactgtactccagcctgggtgagagagtgagacccaatctcaaaaaaaaagaaaaaaaatagataaaaataaaattgtcattacaaacaatttaaatgaccaacactagggtaaaggttaaataaattatggtatactccgctatggaatgccatggaattgtatggaatggaataccatgcagcttacagtaaactccatgccaggagcttgaatgcaggttaaatgagtaagacatacctacactcactggtaaggaaggatattcatcatgtaggaagtgaaaagagcaagtcatggaacaacatacagtacaatcctgtttacatttaaatacaaaagcaaggtgaatgcataaatacataaaggttcacaagagtggctacatctggaaaggaaaatgggttgcagataggtggagatttgcatgttttagtctttataaagttctatcatttgtctttatggtaaacatagtatttttaaaaacatgtaaatattttaaaaaactaaatcaaatgaaaataaaactgcgcaattcaatagtatgtactgaaagcattttaaaatattcatacactttgactcttctatttctgggaatctgtcctaaggaaataatcagaaatgtgtgcaaatgtatattatgaagtagtaagtgctctaacatagccaaaatatattcgcaagctactgttaaatcccattatcactctagaaattgtaagtgcccctttcccaccagaaagtttttcatagcaggtatggggcccctctctgaataaggccataaggactactcactcctatctgcctaaagtaggtgggcagctgtcccatatgttgaacccatctgagtttcctctccatggaaacaaggttatcaaaaccagaactaagtcactaaatataactgtttttccttatctaaacacatgtaattaaattatgactctcaaaatacataaattgggaaaatcgaacaatttatattatctgtgctactttcttccagtgatgcatataattcagagccaaattctggaaattgtggatttttttccttttatttaatgttattattatttttagagacagggtcttgctctgtcacccaggctgcagtacagtggcatgatgatagcttactgcagccttgaactcctggattccagagattctcctgccttagcgtgctgagtagctaggactataggtatatgccaccatgcctggcaaattttttttttctaatgtaaagatggagtctcaatatgctgcctagactggtcttgaactcctggattcaagccattctcccaccttggacttctgtccctgaggactatagctgctgggactataatgatgatttttattgtacaccgtgcttaatgtagcagtatggctaacataggtgagtagagatacctaccagcataccacaaccttgggtttccttcttccattcgatttacccatgattcattccaagaatgagcaaaatctaccagcagcaccagctgaatgaggatgaagagggcggcccctatcatgccaacaacaaaccagactacaagaaccaagagaacaaagttattctctaccatagagtaacatttcagaagatccaacattctgaacggatttcaattaaaacaagacagaggtggtaaagacattctgtctccagcagtacagcaagattccaaactcaacggcattcttaaaagctttctactgggtttcagaccttttaaaatatgttttagcttgtgccaagggaagcctgggacctgagttccaaatgatactataagtcttttcttttaaatcacagtagaaatctaaagatgtcacctgatgccatgcttaggaagtaggttaagacagagataggggagcacaagagttgtaagtccttattttgacaggctctctgattagctttgtattccatcaagtgagaacacaaactattaagatattgccaaaagattaacatatggttccagaaaatctgagaggtgcagtgaatgcctcctgacctaaatccacatattaataatgagttgcagccgggcgtggtggctcacacctgtaatcccagcacttcaggaggctgaggcaggtggatcatgaggtcaagagttcaagaccagcctggccaagatggtgaaaccccgtctctgcctaaaatacaaaaattagctgggcgtggtggtgggcgcctgtaatcccagctactcgggagactgacgcagagaactgcttgaacccaggaggtggaggttgcagtgagctgagatcgtgccacggcactccagcctgggagacagagtgagactgtctaaaatatatatatatatatagtgagttgcaggtactaagtcatattaatcggataccatctcatttacttgtcagttctacaaaaacagtaattaaaaggtagttttgttttgttttgttttttgagacagagtcttgatctgtcgcccaggctggagtgcagtggcacgatcttggcacactgcaacctctgcctcccaggttcaggcaattttgctgcctcagccttctgagtacctggaatcacaggcgtgcaccaccacgcctggctaatttttgtatttttagtagagacagggcttcaccatattggccaggttggtctcaaactcctgacctcaggtgatccgcccgtcttggcctcccaaagtgctgagcttacaggtgtgagccactgcacccggcctaaaatgtagctttaactcaatcatctatagagtttatatagtttaaaattaaccccctcaatggtgaaccctacctgagctgaaatagcccccagggatgtagaaagagccaaccatgattccaataagggcagcaattttgaagaaccaaaacctattaaaatataaaaatgcatttatgaaatgctaagtttcacccttatactgagaaaaattcatttctgaaatgcaaaaataataacttaatagcttttttcccaacatgattgtctggactattttcttcatttgactattcatttaataggctaattcatttaatatttcacacaattaaaggacaacattagcctagaagataaatcactcacatttattaccagagaaaactgaaaatttagagtctccctacttttagcacttaaaggtaggcatttttctagcattctgggagttctaaaataacagtgttaggtacacacacagccattaactgttaaggtctggatgaaaagtaatcacaaatatttacaacacagggcacagataccttgcccacaatgacacagctcatcactggcacctgattttcagttcatgatctttaatgactgccttgtatggcagagtggaaagaaccaggctttggagctggacagatctaagtttcaatcttagctccaacctccaactggttaacaggtctcagacaatttattaacctctctgcagttcagttactacatctgtaaaaaggggattataatacacatcaagtttataaaacgccattcagtctttgagaattagaaatacggctgggcacagtggctcacgcctgtaagcccagcacttcaggaggcaaaggcgggcggaccacctgaggtcacgagttctagaccagcctggccaacacggtgaaaccccatctctactaaaaatacaaaaattagccaggcatggtggcaggtgcctataatgccagctactagggaggctgaggcaggagaatcacttgaacccgggagggggaggttgcagtgagccgagatcacgccattacactccagcctgggtgacaagagtgaaactccatctccaaaaacaaaacaaaaaaaaaaaaaaaaaaaggagagaattagaaacataggtaaaaggtggtcaggagtcagaagcaatagaatatgtaaatcagtagcacatatatattcactgacttttgtacactgtttaaatttatcaggtacatgtttatctttaaacaacagaaagaaaaaagtgtgtgtgtacgtagtatctagcatagtgcttcaactatttaacaggtgttcaataaaaatctaagaacatgaagcaaaggaatttaatagaagaaaataaaaagacaagaccccctatcccctccatgttacagcaatctaactgaaaatgacattaaaacaatttcacatgcataatagatcagaaatgcatctgagccactcatttacatattccattgatttcatcagaatggctatattaactgctgaagggaaggaagagccacaccataatgtaaccagttaatcataaatctaacatacccattgtgtactgccgctcggagatctttacttgtttttactttgaacatgagcagagaaaagacaaagaaaaagatggccatggcaaagctgatccgatacacagctttataaccaaccagcacatcacaatctttatctgcatttatatcagcctcatggattttaaatcccccttcacaaaatccaggaatctggaaaaaagcaatttcaatgttacgagaatatctacatttagacagagactctaacccactgcaggaaagcctggatttagaaaattaactacttcaacaactgcaagactgactatggaatttttctctttgtcttccaattcatttacaatcttgttaccaaacagtataaataacatgcattttaaaaataaaaatgctctctcggctgggcacggtggctcacatctgtaatcccagtattttgggggaccgaggtgggtggatcacgaggtcaggagttcgagaccaccctggccagcatggtgaaaaccctatctctactaaaaatacaaaaaattacccgggcatggtggtgcatgcttataatcccagctactcgggaggctgaggcaggagaattgcttgaaccagggaggcggaggttgcagtgagccaagatcatgtcactgcactccagcctgggcaacagagtgagtcttagtttcaaaaaaatatggtctctcttctttgcccttttaggatgaagaggctgtgtgccactttcctgtgagattttccagctacgactgagtccttccaaaggtgaagaactagtccagtttagatgcttcgacctttaacacataaggaaagaaaatgttttggagccacccttttaatgttttctctcagttgttcgactggagcccagatgttcattctgtatttctggaaaaggactaatgtcctcatatttctgtgttttgaccacacccccatataagtaaaaaatctccaaattacaaccaacttgattaacaacgacgaaataaaactagaattttgcagaatataaaaataaaaataaccaataccttaagggcactgttacttcttaccttcttcaagtaagtttccatctcttttctctgcatgatataggatacgacagtgctcaggaggagaatgaaagcataaatgaggcgagtcaccgtggaattcttactgttaggacagcaactacacagcaaacatgaggcaccgctgcagaggcatggaacctggaatgagcacaccatggtcacctgagaccgccttcagtatactcctttatgacacagatgtcgcagaagagaaagcgaggcaaatcaggctttatagttttaactcagagaatcatggctgggaggaagtggttaaaagtacgggctctggagtaaatattatttctgccgctttttaccccagcaagttacgtactctaaccccatttgaccatttgtaaaatgagctcaataatggaattttcctccctcagactctgctgtattaaatgagcactcaacactacctaaaatgcattaacagttcaataaatgttaattatattctgagagcatcatttgttttaaaatatgagaaaaatataaacctaactccacttgctgcttactgcgaatccaagttaccaaagctgatattacaacataaagcaacatgccgggcgtggtggctcacgcctgtaatcccagcactttgggaggccgaggcgggtggatcacaaggtcaggagatcgagaccatcctggctaacacggtgaaaccctgtctctactaaaaatacagaaaaaattagccgggtgtggtggcggacgcctgtagtcccagctactcaggaggctgaggcaggagaatggcatgaacccaggaggcggagctcacactgagctgagattgcgccactgcactccagcctgggctacagagcgagactccatctcaaaaaaataaaataaaataaaaaaataaagcaacactacatggaaaccctctgacaaataataacagcaagggccatttagctcaattcaagaggaaccaggttcctcagaaagttaaatacagaatgaccatatgacccagaaagtatatacccgaccccaatagctgttttgtttgaaactgctattaaaacaaaagcttgtacacgaatattcacagcaccactatttacaatcaccaaaatgtggaaacaacccactgtccattaattgataagtaaatatggcctaagtaaaaatatggtatatctggctgggtgcggcagctcacacctgtaatcccagcactttgggaggctgaggtgggcaggtcacctgaggtcaggagttcaagaccagcctggccaacatgatgaaatcccatctctactaaaaatacaaaaattatccgggcgtggtggctcatgcctgtggccccaactactcaggaggctgaggcaggagaattgcttgaacccaggaggtggaggttgcattgagctgaaatcatgccactgcactccagcctgggcaacagagtgagacttggtctatctatacaatggcttattcagacataatagatagatacatgatagaacacaggtgaaccctgaaaacatcatgcaaagttatttaaaaagccagacatgaaaggtcacatactgtattagtgcatttatataataaaatatccagaataagtgaatctagagacagaagattaggggttgaagggaagggaaatgggagtgatggtttaatgggtaaaggatttccctttagggcgacgaactagacagatgtgatggcagcaaaacattgtgaatgtactaaatgccactatacgcttttttatttttttttttttgagacagtctcactctgttgcccaggctggagtgcagtggcacaatctcggctcacggcaacctccacctcctgagttcaagcaattcttgtgctttagcctcccaagtagctgggactacaggtgtgcaatgccacccccagctgatttttttttgtattttttagtagagacagggttttgtcatgttgcccaggctggtcttgaattcctgagctcaggcaatccacccacactggccaccgaaagtgctggattacaggcgtgagatactgcacccggcccactaaacattttgaaatggttaattttatgtcaactttacctccttttttttaaagagtaacctagggccaggcgtggtggctcacgcctgtaatcccagcactttgggaggccaaggcaggtggaccacaaggtcaggagttcaagaccagcctggccaagatggtgaaaccccatctctactaaaaatacaaaaattagccgggtgcagtggcaggcacctgtaatcccagctactcaggaggctgaggcaggagaactgcttgaacccgggtggccaaggttgcagtgagccaagattgtgccactgcactccagcctgggcgacagactgagactccgtctcaaaaaaaaagagtaacctagatctttagtctgctaaaatctgttagtgaccacactacatgaaagaagatataattttatttctttttttcttttctttctttttttttgagacaggttctcactctgtctcccaggctggagtgcagtaacgccatctcggctcactgcaacctcaccctcctgggatcaagcaattctacctcagcctcccaagtagctgggattacagggattacagacacgtgccaccatgctcagctaatttttgtgtaaagacagggtttcaccatgttggccaggctggtctcgaattcctgacctcaagtgatctgcccgcctccgcctcccaaagggctgggattacatgcatgagccaatgcacccggcctttgttttgttttgttttaaaaagacaaggcgtcactctgttgcccaagctggagtacagttgtgtgatcacagctcactgcagcatcaaactcctgggctcaagcgatcctctggcctcagcctcctgagtacaagcaagcaccaccatgcccagctaagagaggatataatttgagtcattatgcttgattaggaaactgcttgaaattgctctgagggggtgacattatcaagtcatattacaaggacaagctaattcagaattagcagaagtaaacaatggataactctggtcttaaaatatggtcccaggaataatcttcatttttttatagatggtatcttgtgtgcactttatgataattttgtgtggtttgcagcagggtgctaacattctaaaaaagttcagttttctcatctgtaaaaatgagcataataccacctactcgaacagggtgattgagcaaagaatgagatgatgtcaggaatataaagaacctagtataatgcctgacatatttatcaggctcaatatatcgtggtagccattattatttgtaattgcaatagcaatgggaaattgaccagccagtctcagtctccaattcttaactacagtataggccaaacactgcagaggcatgtcctccacaaattcttatgttgaagtcctaatgcccaattcctcaaaatgtatccttacttggtcactgcagatgtagtaagttaagatgaggttatatggagtagagtgagcagctaattcaatataactgtgtccttataaaaaggggaaacttggacaaaggcttacaacacagggagaattccacatgccatgtgaaggcagagatctacaagccaaggaacatcaaagactgccagcaaaccaaaaaaaaaaaaagccaggggagaggcatgatacagattctctctcaccacccttagaaggaaccaaccctgctgacaccttcatcccagacttccagcctctagaattcagagataagaaatcactgggtttaagccactcggtctgtggtactttgttataaagccctggcaaactaataaacttacttacctatagttgtcttaagaatgtaaatatctcgaaggggagactatctttacaacgttatatcttttgtatctttacagagcaggtactcagtaaatatctgtgggacaaatctgtcctactatatgttatgtcatttttctatttcagtaaatgacaactccattcttcctgttgcttgggcccaaaacctggagtcatcccgaatgccttcccttttcccaaaatcctcatccaatctgtcagtacatcagctctacccttaaaatatatccagaatctgaccattttcacagtatccttagctatcacctttgtccaagccacaactatcatctctcatctggattaagcgcaaaagttcccatctcacagctgtagcgacccattcagaagctctgagttggccggcacagtggctcacgcctgtaatcccagcactttgggaagccaaggcaggcagatcacctgaggtcaggagttcaagacccgccaggccaacacagtgaaatcctgtctctactaaaaatgcaaaattagcctcaaaaaaaaaaaaaaaaaaaaaagaagccctgaattgttataaagattattttaagcttttaagctgaagcatctgagcttcaacagatgcagaggaaaaaaaaaagccttctgggagcttctcttatctgactaaaagcagcaacttctgggaaacgaggctgccataaagtccctctccagggcagttttaagatcatgaagaagctggaaagacccaccatacctgcataaacaagtactaccacaaacgtatttcctatttattctcctaaaaaaacttgtctttcctaaagaaacctatttgttcttctcatagaagcctttctcccagcttcctttttcctactaaattagaaagccttggctgggtgcagtggctcacacctgtaatcccagcactttgggaagctgaggtgggcagatcacctgaggtcgggagttcaagaccggcctgaccaacatggagaaaccccatctctactaaaaatacaaaattagccaggcgtggtggcacatgcctgtaatcccagctacttgggaggctgaggcaggagaatcgcttgaacctgggaggtggagattgcagtgagccaagatcccaccattgcactccagcctgggcaacaagagtggaacttgttttctcaaaaacgaaaaaaaaaaaaaaagcctcaagttctaaccgccccctttgagttactattactgagcactcctgtgtgtacatgtcttgcatgcataaactctaaataatctgttttgtcagtttaattcacaagcccccagaaacagaacccaaaaggctggaggaagattcttcccagcctacactgctttacctttacttttctaccatctattctccacacagcaaccagaaaccacctcgttaaaacacaggcccagatcacatcactccttttttcaaactctgtaatagattcccatataacttaagagtaaaagccgggcaagacgcggtggctcacacctgtaatccaagcactctgggaggccggcggatcacgaggtcaggagattgagaccatcctggcgtgagccaccatgcctggccttcaactcaccaggattttctaatgtgatagaagataaaagaaaaattgtacagtaaacgattatttcataaaactttgtctctatatgggtgcatcagatcacagatcaactatgtacaatctttctttaggtcaaggtcagaataattagaaaaccactgctctcaagaaagcccttaaaaatggaacactcttttgatttaggaccaacaaccttaaaatacattctgttcctaagaaatagtggaatgaagccaggcatggtgtcacacacctgtactgggaaggctgaggtgggaggatcacttgaatccaggagttcaaggctgcagtgagctatgactgagccactgcactccagcctgggtgacagagcaaaactctgtccccctccaaaaaaaaaaaagaaaaatagtagaaagagctgaaacagaatccttggtgtaatactgtcaaatatatgtatgtttggttcccatttcctggcatacaatttctaaaatccttggaataaccagcgtctttttgtatgctaatgagatgactggtgactggcagcccctaggtggcttcatgatgggtgagggtcatagtaggaggttgggacttttcagtctcacccctgaccctccaaggaggggctgaaggttaggtcagtaaccaaaagccaatgatttaatgaatgctgactacataatgaagcctgcataaaagctcagaaggacaaagttcagaagaacttttggctgggcatggtggctcacaccccaggagttcgagaccagcctggccaacatggcgaaatcccgtctttattgaaaatacaaaaattagctgggcgtggtggcatacactataatcccagctactccgggaggctgaaacatgagaatcccttggaggttgaagagagccgagatggcgccactgccccagacagagcatggaagctccagacccgttccctctacaccttgtcttacatatcacttcatctgtatctttaaaaatatattaatagtagccataaaaaaagaagaaaatcatgtcctttgcagcaacaaagatgcagctggaggccactatcccaagtgaattaatacagaaacagaaaaccaaatacagcatattctcgcttacaagtgggagctaaacactgggaacacagacacgaagatggcaacaataaacactggagagtccaagagtggggaaggacggtggggggataggggttgaaaaactacctgttggatactgtgttcactgtttgggcaacggaatcattagaaacccaaacctcacgataaggcaatatacccatgtaacaaaactgcatatgtaccctctgaatctaaaattaaaaatacataaatacacaaaataaaatacttttataataaaccagtaaacatgtttccttgagttttgtgaccaaattaatcaaagccaaggagggaggtcacgggaactttgatttataggtggccggtcagaagcacaggtaaaacaacctgaggcttgccattggcacagaaagtgggcacagtcttgtgagactgagccctccacttgtgtgatttgatgctatctccaagtagagagcttcggaattgacttgtagggcaccaagttggcatcccctgcagagctgactgtttgcctgatgtttgggggaaaatccccacacaccacacatcaggtgtcaaaagtgtgttgtgagtacagcaggagaaactgagtgtgctttttctacacacttggtcaattaaatcagctggagaatgaggaatcaaggaatcacgctcctctgaagtgggtaaatgagggaactcagcatattcttttataggccctataattttctctttaaaatgtttacagtttacaaggtgattaaaccttcacttcactgtcacaatcgttctcgaagagaggaatgctggggtgattatcctcggataaatgacttacagcagtcccaaaatattcaggccctggtttccaattttgaataacaatccacaagggcttctttcccttgcacctgaactgcagacaagcctccgctaaaaccccagctttgccacacactctgtagttttggcaaatcccgtgctaggggataaaaatattacttgagccacctagaactaaatgatggcaccttaagaggtgcttcgggaggaaccggagcccctcgctgggagctgtcattccttggtccctctccagctccagaggaacctagtcaggaagcctcgcagggcggagccatccgaattgtaaacaatggcggcctagcctcttccgttccccgaggaacccggagggcgagccgcctaagctggacctgagggtatcgcggatttgcgtctggggccccggagaccctctgtagcccagggcctgctgacatcccgagagcctctggagccaaggcccgtgcagctctggtctcgaggcctttccccgcaaaccgcaggtccggcgaggactcgggaccccgaactcacccagctggcgagggagaagacacccagcacagcccccatggtgacgccagtgatggaggtggccggtcctgaggctgctttctaacacggtggtaactgccagctgaggtgactccccagaaacatgacggtttctcaggccggaaacgcagccttccacagacgcacggatgcgtcacggcgtggccccgcccaccgtccgcgaccggagcggcagaggggggcgcctgtcattggctgagggggaaggtggggctaaaccatcctggggttgcaggaactgtgaaggtgtcattccttacatcatttgtattcattgtgcaaagatctggaagttacagaagtgtacagagaggcacagtacgctcagaatttattctctagttaataggagatctgacaacataaatgcaccgtgccccaatgtaatgaatacgatgaagtagtatgggggaataggctttcaataaaggtgtatttagtgcctcctattgtaaggggaaagtaatttagctgggcagtagtcttggaaggcttctctgaaggatttattttttaatctgcgaactaaaggatgagtccaaattaacctagaaacgatggaaatcgtatcctaaaatgtgggatgcaccccatttgggaaaaatgaatggctctaagggtgcatgaaggacattaagcgatattaaacagcagagtgagaacgtcccatttcaaaccaacaggctagttgtttgaggccagtatggtatttaacatttttctagtatttatctccctttctaacagagtaaagccttcattttccagatctctcaaacaggcaaccatgcctgcagttttaaaatattgttttgttttgaggtgtgtgttagcaataaccttttcatttcttccgagcaatgctgatttcccatttaagcagtgatgtaaatattcctttcaaaatacatgtcaaatttgagagttcacttaaagaagaaaatgaaaacattttttacttacacatataatagtttaggtggaatgtggcaaacaatgatgatgtccggacaacaaggtgtcacacttcaatatcttctcctgtggtgtgttaatcttccctgatagataaaactctctggaaggggattcataattgaattccttctggattgtcagcctttagtctgataagggaaattcatgaaaagcccctctctccatgtgctgttccccaagcaatcatcataccagtgtggcatatttggggatgttatttcctggattccttgaaaatgtattccaaattcatcttttacagaaatggaatgaggctcaaagtttgcccaaggccatgaaaagggctgatgaaagaagaaagagaactactcacatttaataattcctacctctcttttcccagatccctctcctcaccacacatacacaaataccagctcaagtcaagttgcttcaggaccactgaactttccaggtagtccttaacattcttgcttcttcctgtctgagtattgctggtctggacttaagagagctgactgtgataaattttacagatcgaattctaccagaaacatacctgtagtcaaaaagaattaggtttatttagcttgttcagaaagggagaacacatatcagagaaaatataaggtgtcttggtaagaggtgactggggagaacttattttaggatttgggtttatgctgggtaactaaatctaaggagagtttaaggaggaggagaacagttttggattggacacagtcaaggagtagaggcaattcagtgattaggtatcttacaaatttttatccagaaggaagaaggattaaaacaaggctagattagtccttggaaaagtgtgataccctaccttgtcttaacctgaattgactctctcttagctgagggagacagacaaactccattttggctccttcacttgccgctccttacccatcccacttcctcaaggatttaacttgtgcaagctgactcccagcacatcaaagaatgcaattaactgataagatactgtggcaagcgatagctgcagtttccaggaattcacccggttgatagtaccctaagcccctgcatttttgtccggttgatggtacccaaagcccccacatctatcaccttgtgatggatttaaagcccctgcacctggaactatttgttttcctgtaaccatttgtctttttaacttttttgcctgttttacttctgtaagattgcctcagctaggctccccctcccctttctaaaccaaagtataaaagaaaatctagccccttcttcggggccgagagaattttaagcactagccatctctcagttgccggctaataaaggactcctgaattcgtctcagagtgtggcgtttctctataattcgctcggttacaaaaaaagaagcaaaatccactcatttattagtcagaattggaagatgttgagtcctatctgcggtaccagagtggctttgtctgtatcttgatccaactacatggtggtcttgtctgatctttgtttatattctgtgatcactgtttttgttcagttagaaacattaggtctagctgtcagctgaacagtttttcattttcttacctgtaagcatttgtcctcccacatgtaggatccccccatctcttagtgtttctggccctaactggttgagtgtgtcacttctacttggccaaagcgaggacagcagatctttgtgatcatctactccaatttcccgcctcaggcagaaaccccttagcaacatctcttctagggtagggggctcactgccacccaaggcagctcctcccatctttacacatccattgtcaaacctgtcaggcctctgagcccaagctaagccatcataaccccgtgaccttcacatacacatccagatggcctgttcctgccttaactgatgacattccaccacgaaagaagtgaaaatgccctgttcctgccttaactgatgacattaccttgtgaaattccttctcctggctcatcctggctcaaaagctcccccactgagcaccttgtgacccccgcccctgaccatcagagaacaaccctctttgactgtaactttcctttacctacccaaatcctataaaacggccccacccctatctcccttcgctgactctcttttcggactcagcccgcctgcacccaggtgaaataaacagccctgttgctcacacaaagcctgtttggtggtctcttcacacggacgcgagtaaaaaaacctaggttatttccccccatatgttgttgaaaagataacacatgtacttggttataacatactgcataaaggagcacacggtgaaaatgaagtgtccttcccacccttcccccacccccatctcccagatctcctttcagagttcctacaggaatatgcatatgccagcattatggcacttttttttttttttttttttttgagacagagtctcgctctgtcgcccaggctggagtgcagtggcacaatcttggctcactgcaacgtccgcctcctgagttcaagcgattctcctgcctcagcctcctgagtagctaggattacaggtgcccaccaccatgcctggctaatttttttttgtatttatagtagagacagggtttcaccatgttggccaggctcgtcttgaactcctgacctcaggtgatccacccgccgcttttttttcacttaacttattagttcattcgataaatatttaccatgctattactatgtgtcaggcactgttgccagtgataagaaaatagtagagaacaaaacaaagtgcccacccttaaaagaccttatgctgtagggaaaaaagacaagcagcaaacacacacgtatataatataacactcagacactgacaagagctgtgaaaaaagagaaaggagaatacagagttggtgggggtccattattttcttttcttttatttatttatttttttttttttgagacagggtctcactctgtcacccaggctggagtgcagtggcatgatctcacctcgctgcaacctcagcctcttgggttgaagcaatactcatgcttcagcctccccagtagctggaattacaggcacataccaccatgcctggccaatttttgtatttttagtagagacagggtttcgccatgttagccaggctggtcttgaacacctgacctcaagtgatccgcgcacctaggcctcccaaagtgctgggattacaggaacgagccactgcgcccggccctactattttcaagagtagtctgggcaggtcttttagagggcttgacactggagcacagacatgagggaaccgaggaagcaagccataaagatacctggaggaagagcaggagaaaatgccctgagatgaaagcatgctttaaggcaggaaaacagagtctggagtcggggaacaaaaggctgattcacacttcagctatgacaggaaatatcctctccatagggtgtaggccaagtaaatgactttgtaactttacttcatccttttcatttacatagggcgtgtcccaagtagagggtatttaaactcccaaaaattctgtaacaggggcccttgagctcctatgcttgggccccctcccacactgcggagtgaattggtgagatggagtcttgctctgtggcccgggctggagtacactggctcaaactcggctcactgcaacctccacctcccaggttcaagcaattctcctgcctcagcctcctgagtagctaggattacaggtgtgcaccaccatgcccagccactttttgtatttttagtggagacggggtttcaccatgttggccaggctggtctcgaactcctgacctcgtgatccgcgcgcctcggcctcccaaagtgctgggattacaggcgtgaaccaccgcgcccagcccatactttcattttcaataaattccttcattccttcttgctttgtgtgttgtgtccaattctttgttcaagatgccaagaacctggacaccctccaatggtgacagctgagagggaaaatggtgagagatgaggctggacaagtattcagggggcagttcacttccagccttgttgatggtgacaacaactctacatcttattctaaatgtaatggggaaacagttgaaagcttttgagcaggtgagggacatggtcatgcttacttttttttttttaagctggagtttcaaaaaaaagccttcagccaccgcgccaatcatgtttacattttattttatttattgttttgagacggagtctcactctgtcaccaggctggagtgcagtggcgtgatctcggctcactgcaacctcggcctcccaggttcaagcaattctcctgcctcagcctcccgagtagctggactacaggcgcacgccaccacgcccagctaatttttgtatttttagtggagacatggtttcactatgttggccaggatggtcttgtactcttgacctcgtgatccacgtgccttggcctcccaaagtgttgggattacaggcataagccactgcgcccggccgtgtttacctttcaaaaggatcattctggctgctggttggaataaagactggagcagggatgggttagggttgagggttatagtagaagcaatggcgggactagttcggagactgttgccgtatacatagctgaaactgcctttgcaaaattatgacggagacagtgaaaaagatctaacttcatcttcgttctaacctttaacctgtccttgttccttcctgggtgtaggctgaactaactttgggaggaacttagtttatagtttaaaacaaagatgataacagccccttcccaaaacaaaccttcctcttgcctgggtactagactgcctttgtaggactaacaaattagccacaagattagaaattatggcttaggagtcatgcagctggaggctacaagattctgaccctccctgaacttctgctaagatcagcgcttgagatattttccagaccctgaacttgatggatcagctggcaccacacagattgataaagtggctcatctgatcttgtggcccgcacccaggaactcagtgcaagaggacagcttcagcttcccatgatttcatctcctacctgaccaatcagcactccttgctcactggcttccccccacccaccaagttaaccttaaaaactctgatccccagcctggagcggtggctcatgcctgtaatcctggtaccttgggaggctgaggcgggtggatcacttgaggccaggagttctagtccagcctggccaatatggtgaaacccccgtctgtactaaaaaaaatacaaaaaattagccaggcatggtggtgcatgccttgtagtcccagctactctggagactgaggcaggagaatcacttgaactggggaggcagaggctgcagggagtggagattgtgccattgcactccagcctgggcaacagactccgtctcaaaacaaacaaacaaacaaacaaaaaactctgatccccaaatgctcagggaggctgatttgagcaataataaagctccggtctcccacacagccggctctgtgtgaattactctttctctgttgcaactcccctgtcttgataagtcagctctgtctaggtagcaggcgaggtaaaccccctggctggttacacagcttgaagacagctctgtatctaaactgtatctacgtctatatctaccttggtccctcttaattcttgctacggtaatctattttattttatggatgtatcataatttatttcctcagttccctaaggatagactttttttttcgtttgagacagagtctcgctctgtcgtccaggctggggtgcaggggcgtgatctccgctcactgcagcctctgcctctcgggtttaagcaattctcctgcctcagcctcccaagtagctgggactacaggagcgcgctgccacgtctggctaatttttgtatttttagtagagatggtgtttcaccacgttggccaggacggtcttggtctcctgacctcatgatccgcctgcctcggcctcccaaagtgctgggattacaggcgtgagccaccgtggctggcttttttttttttttttgagacagggtgtccctctgtcactcaggctggagtgcaatggcacagtctctgctgacttcaacctccgcctgtcgggctcaagggatcctcccacctcagcctcctgagtagctgggactacatacaggtgcacaccaccacacctggctaattttttaattttttgtagaagtgaggtctcactatgttgcccaggctggtcttgaactcctgggctcaagcaatctgcctgcctcagcctaccaaagtgctggactgcccaaggggttcaccttgcacgctgcctagacagagctgattaatcaagaagggggaattgcgacagagaaagtaattcacacaaagcctgctgtgcgggagcccagagttttgttattactcaaatcatcctcccgaaaactcaaggatcagagtttttaaggataatttggtgggtagggggccaatgaattgggagtgctgattgcttggctgggggatgaaattgcagagagtcgctgggcgcggtggctcatgcctgtaatcccagcactttgggaggccgaggcgggtggatcacgaggtcaggagatggagaccatcctggctaacacggtgaaacctcatctctactaaaaatacaaaaaaactagctgggcgtggtggcgggtgcctgtagtcccagctactcgggaggctgaggcaagagaatggcgtgaccccaggaggtggagcttgcagtgagccaagatcgcgccactgcactccagcctgggtgacagagcgagattccttctcaaaaaaacaaaacaaacaaacaaaaaaaccagaaattgcagagagtcaaagctgttttcttctgctgagtcagttcctggatgagggccacagaactggttggcaggtccagtggggccatctggttgttagaaatgcaaaaacctgaaaagacatctcaaaaggctgatcttaggttcacaatagcgattttacctcaagagtaattgggggccaggcacagtggcttacgtctgtgatcccagcactttgggaagctgaggcaggcagatcacttgaggtcaggagttcaagaccagcctggccaacatggcaaaaccccgtctctactaaaaatacaaaaattagctggcgtggtggcaggtccctgtaatcccagctactgtggaggctgaggcatgataattgcttgaacctgtgaggcagaggttgcaataagccaagattgtgccactgcactccagcctgggtgacagagcaagactctgtctcaaaaaaacaaaacaaaaaaatcttatgacctctagaataagaataatggtgggtactatttagaactccagcccttctcatcttggcttggtggctggtggcctgtggcctttcatttgttttacaagaacagtttagctttctggaaagggctattgtttaaatgatacactaaattccttcccaaggctagtttggcctggcttggcatggtggctcacacctacaatcccagcactttgggaggccgaggcgggaggatcacctgaccaacatggagaaaccctgtctctactaaaaatacaaaaaattagctgggcgtggtggtgcatgcctgtaatcccagctactcaggaggctgaggcaggagaatcacttgaactcaggaggcggacattgtggtgagccaagttggcgccattgcactccagcctgggcaacaagagcgaaactccgtctcaaaaaaaaaaacaaaaaacaaaaaaacaaaaaaaactggtttagcctatacccaggaatgaacaggacactttagaggttagaagcaagatggggtcagttaggtctgatatctcagttatgattttttgcaaaggtggtttcaggatgacaggtgtgagccattgcgcccagcccctgatagatatttagactggtcgcaacccttttgcttttacaaaaatgaattaatgaatatatcctttgtgctcaggtttcagcatatctgcagagttattccaagaagtgtagttgctagacacaaggaaaaataaattattcctcatattgaaattaaatctggtgatctaattctccatcaaagaaaccaatttattcactctttgccacaccaccccttcagagactataaaagagaggaatctgccacccttcccacatcagttttcttgtctttaaatattcccagtcttggcagggagtggtggctcacgcctgtaatcccaccatgctggtaggcccaggcggatggatcagctgaggtcggagttcgagaccagcctggtcaacatggcgaaacctcgtctctactaaaaatacaaaaattagccaggcgtggtggcaccttccggtaatcccagctactcgggaggctgaggcatgagaatcgctcaaacccagggggcagaggttgcagtgaaccgagattgcgccactgcactccagcctgggcgacagagtgagattctgtctcaaaacaaaaacaaaaacaaaataacaaaaacccagtctaccaagccaccacctgaggccctgtctcctcctcgcacggtccccatttgaggttacagagagataaactgaggcacaagcagcacccgcggcccaagacctccccttggcctcactgtccccctttccgtatcttccccgggccaagttccaacccggatccctccttcgcagctcagccctcgactcccacttcgtccctcctctgccccctccgcggctgcggaaggggacgcgaaccgtcctggtcccatccgagccgccgtagcgcgagtgccgcgggagttcggcagcccaggtcgccaaggcaacgggctccgctgcgggttgcgggctgcgggcgctaggctgccccggggaggcgctgcggaccggcggcccaggcacggagaggcggcgagaccgcaggtgagcaggagccgggcggccggttgcggccccaacgctccgggcctggcgtcgacacgtcgcagggggcgaggggctgagccgccggggatcccggggagggaggctgcggcccgatctttgtccctcagccgcgccggggacggcgcccccgacgccctttgaccccgccccgcgttcagggagagtccgttttcggctgtttattatatttgtagccattggtcgacctcattcgaaagtttcttaaaaaaaaaatcccttcttgtttgggggccagaaaataactcaaaactgtgcagaaaatttatttgtgtgtgtgactcttctggggccagagaggattgacttctttgtgcgtcagttttatcgtctgcaaaatgggaatcatggtagcacctgtctgatgacgttattacaaggtaaatttatatttaaaattcgtggaggtaagccctcaatacatgggagcttttattattactactactacaaggaggaccatcactgagcatttattgtgagccacggcccgggctgatagccagggtaaaaaagtgaacgagagacatcgtgtcctgagggaactccacagttttccggaggagacagactcgtaaacaagaattcacagtgattccggttatgattttggacatacaggggggctgtgaatgcacagagaaaacagttaacctggatttctggaggtgaggttagtgtggatgatcagggagagatgccaaaagaaggtgacttccaaaatgagacatgaaggctgtctttatgttggccagaagatgaggctggtggagtgtaccttgctgtgggtagataaagcaggtagagaaagtaggtagagaaaagccttggggagagagtgcagacttcttgggaatctgcaaggatttcaggctagctggagagcagattatgagagttggagggggtctggctagatggtgtttgagagacaagcaggtgctcctcctgaaagactgtaagtgtggaggagtttgggctttgtgttgggggcagtgggaagccatcaaagggttttaagccggaggtgtgtgtctttgatcagaggtatagtttcagaaagatcagttttttgtgtttctctcttggtcttatcattcctcccatctgtttttcactttgcaggcattcatttgtggtgattcatatatatgtgtgtgtgtgacagtgtgtgcgtgtatgtatttattgttgagatgaggtctcactatgttgcccaggctggtctcagattcctgggctcaagtgatcctcctgtctcagcctcccaagcagctgggactgcaggtgcacaccactgcacctggctaattcaaaaaatatttaatgagcatcttcttctatgtgcaaggcactgtgtaggtagtaaggaagcaggtccctgccctcaaggagatcacagattggtggagaaaatattcatcaaacaagtgattataattgtgatgagaattgtgaaagggggcgcatgttaagatcaatctagcatagtttggagattcaggtagagttttgataaaatgtatggagggtgtagtctgagttagctatcgtggggatgttccaaacattttcaaaagtacattcatggagccaaaagcagtccactacaactggaacttaaagatcaatattgaaagagatccatccagagaggttgacaaaaaaaaaaaggctgagattattcagggctactgcattgcatactcttggaagaatgagccatgcacttagtctacactaaaagaaatggctagagaaacaggaacaggagagaaaccagcaaagtatagtaatgaaggccaaagggagaggttggttggcctttgtagatgttgctgagatgtcgagtaatacaagttaaaaattaaaatgtgtccttttgggtaaataaatatggaggtcggttgggacctcattgagcagatttggtgaaatggttggggcggaatctataatatcagcagctttcaaaggttcaatataatatatcagtgggatgagttaagagtgggatgtgagaaagacaaagtgtaggcagctcagagaagtttggctgcgaagggaggtagagagaaggctgaggagcgattggggaataggtgaagtttttttgagcatgagagagattaaatgctgttggcaaagagccagtggagagagagaaaggctgagaagacacaggatatgaaagggagaattgatagtataactttcctgagaaggtgggagtggaggagctccacagtacagatccttcaataggagtctgatgcctgttactttttggagacgtgggaagccaggttattcctgaaaggagtgcaccagtgtaatgcaacaaaaataaataaaggtataagtgtggaaggaaagtcacaattttcattgtcggcagatagcaggcatttattgaactagtattgtgttaagtacttttcatgcaccattcttttttttttttttgggacagggtatcactctgtcgcccatgctggagtgtagtggtgcaatcttggctcactgcagcctctgcctcctgtgctcaagcgatccacctgcctcagccccccaagtagctgggaatacaggtgcgagccaccacactcagctaatttttgtatttttagtagagatgaggttttgccatgttgaccaggctggtctcgaactccagacctcaagtgatccacccgcatcggcctcccaagatgctaggattacaggcatgagccactgcgcccggcctcatgcaccgttcttaatgaataatgtgatgtttacaacaaccctgtgagataggccctctaataattgcaaatttatggataaagaaactgaggtaacatgctcactcagggtcacacagtatttgaatctaggtttacctgaacccagagcttttactcttaaccactacctggatgatataaatctctacctgtgatatgattgtctgctgagaaaattcaagagaattaaactaaaaatacttagatataataaggctaagtgaacagcagttataagatagacaaaaagcaatagctttatgcaaacaaaaatagaaaatgtaattgtaggagaactgacaatagcaacatgaaaaataaatacttagaaataaacttaaaaatacatgtacccagcttagccacacagagtaagagttggctgggcatggggatgggatgacaggatgagtaaggtaaagtagttttcccatgggaacatcagagtattgatactggagaaggggtaggttaaaaaaaaaacaggtgtctatcataagacatcatgagatattgactatcatgtttttataaaattgaaaaattggcctggcacggtggcttacgcctgtaatcccagcactttgggaggccaaggcgggcagattatctgaggtgaggagtttgagactagcctggtcaacatggtgaaaccccatctctgctaaaaatacaaaaattagctgggtgtagtggtgcacgcctgtagtcccagctacttgggaaactgaggcaggagattctcttcaacctgggaggcagaggttgcagtgagctgagattgtaccattgcactccagcctgggtgacaagagcaaaactccatctcaaaaaaaaggacagttaggtgggagctatatatattagaaagatgtttacattatgtggttaggtgtaaaaagcagattacggtacagtatgttactgttttcttaaatgtatacatgtttataataaaaatgtctggaaatactagttctttttaaaaatgttaaatctttaattgtgataaaatttaccatcttaacgatttttaagtttacagttttgtagtattaagtgtattcatgctgtgcaaccaatctgcatgactttttcatcttgcaaaagtgcaaaagccaaactatacctttaataggtttagctccccatttccgcctccccaccagcccttggcagcacccattctacttttgttttctatgtgtttggttactctggatacatcgtgttagtggaatcttgcattatttgtctttctgtgacgggcttatttcactagcatagtgtcctcaaggttcatccttgttgtgtagcatgtgtcagaatttcattctttttgtaaggctgaataatattccattgcatgtttataccgcactttgtttatccattcatcgatggtcactttgagttgcttccatcttttggctattgtgaataatactgcagtgaaacataagtgtactagaaaggtaagctgtttatgagatcatggggaaacttttattctgttcctcattgccctaattttccttttttatgagcatgaattgccttcataatcagaaaaaaaatgaggaagtatcttctttaggaggctggggaaataagggtaaaaaagggcagtggcagcggaaagggaaaggagagggcagatttgagagacatttcagaaggagaatcaacaggacttgaccaacaagaggtaagggagagaggagtggaagatgaagctttcctggcctctggtgggaaggggcatcagtcctggtggggctttgactaggggaggagggaggaaataaggctggagagccacccaagcctttgtttagcagtttggacttctagaaggtggagagaaaccattgaaaggaagtgaaatgacttgatctgatttgcacatagagagatgacactggctctttccaaccattctttaaactgaaggcagatagtgccaggtatccctttgtgttgcttatacttgaacttctgttaatttccttttatttgagatgaacctttagtactgaagtacacatatctattattctaaaagcacctggaatattttaaacaatgttttagtgtgtgtttttttgttttttgtttttttgtgtgtgttttttgagacggagtctcgctctgttgtgcaggctggagtgcaatggcaccatctcagttcactgcagcctccgcctcccaggttcaagcaattctcctgcctcagcctcccaagtagctgggattacaagcacttgccattatgcccggctaatttttgtattattattattttttttgagatggagtttcactcttatcgcccaggctggagtacaatggtacgatcttggctcaccgcaactgccacctcctgggttcaagcgattctcatgcctcagcctcctgagtagctgggattacaggcacgcgccaccacgcccggctaattttgtatttttagtagagacagcattctccatgttggtcaggctggtcttgaactcccaacctcaggtgatccactcgccttggcctcccaaagtgctgtgattacaggtgtgagccactgctcctggcatttttgtatttttatagaaatggggtttcaccatgttggccaggctggtcttgactcctgacctcaagtgatctgcctgcctcggcctcccaaagtgctgggattacaggcgtgagccaccgtgccctgcctgtgttcagttttatctcaataacacagtctcctgtaaatatacttacttttttttttttttgagacagagtctcactctgtccctcaggctggagtgcagtggtgcgattttggctcactgcacccttcgcctttgaggttcaagtgattctcctgcctcagcgtcccaagtagctgggattacaggcacacaccaccacaccggctattttttttttttttttcatttttagtagagacagggtttcaccatattggccaggctggtctcaaactcctgaactcagatgatccacccatcttggcctcccaaagtgctgggattataggtgtgagccactgcacccagccatcctgtaaatatactttctgactttagtaggagaagtatgaataattgggaaaataaatgaaacaaaaataattcaaggtagagtatgtcacaattctgttaaaattttaaaatttaaaatttttcacattttactgaattctgacagcctccttttgagagaaaaaggacaatataaggtatacagtgtcatattaaggaactcttacaaaatgaaaatttggagggtccagatggattcagcccgtcacttagctccactcccacaaacctgtagtctctgtctacttccagagcattacagacagagggagctaactgttgtgctaacatttgtaaatagctctgcagtttagaagagctggatttccaaaagatgtaaatccatgatatcattttagtcctcctaacaattctgtggggtagggattatcattcccattttcaaatgagaaaattgaagatcagaggatgtgacagatccctctcagatactatatctaataagtcctggagtttgaatccaggttttattttcttcttatattttagcattttattatggaaaagtttaaacatacaaaagtagaaaagataataaaagacacctaatatactgagctttagcaattgccaacatatggtcacttttattttatctatactgcctacttccatcccaccttaaattatcataaagcaaatcctagtcatcatatttcatccatgaatactgtacttcaatatacacatctaagagagaaggattttttcctcctcctttcccccctgtagtcacagtttcattattacacctaaggaaataaacagtagtcagtcctaaatattacataatatccatttggtattcagtttcctcaacaattttataaatgtctttctaaaaaaatgtttttttcaagatggagtctcgctatgttgctcatgctgtacttgaactcctaggttcaagtgatcctcctatctcagcctcatcagtatctggaaatacagatgtgtgtcagtgtacctagctttttttttttctttctttttgacacagagcctcactcttttgcccaggctggaatgcagtggcgtgatctccactcactcactgcaacctctgcctcctgggttcaagcaattatcctgcttcagccacctgagaagctgagattacaggcacgtaccaccataccccactaatttttgtatttttagtagagacagggtttcactattttggccgggctggtctcgaactcctgacctcaggtgatctgcccgcccacctcagcctcccaaagtgttgggattactacaggcgtgagccatcatgcccggcctgcccaactttcataaatgtctttttacagttggtctgtgttcactgggatccaaacaaggtgcctgtattagacctgattgatgatctcttaaatcaagcttgtccaatccgcagcctgtgggccaaatgcagcccaggacagctttgaatgaggcccaacacaaatttgtaaactttctttctttgttttttttttttttgaacgaagttttgctcttgttgcccaggctggagcgcagtggcgtgatctcggctcactgcaaccttgcctcccatgttcaagcgattcttctgcctcagcctcctgagtagctgggattacaggcgcccaccaccacgcccggctgatttttgtatatttagtagtaacagggtttcaccatgttgaccaggctggtcttgaacttctgacctcaggtgatccacctgcctcggcctcccaaagtgctgggattacaggcatgagccaccatgcccagcctcaaatttgtaaactttcttaaaacattatgagattttttgtgtgtgtgattttttttcttcttccaatgtggcccagggaagccaaaagaatggatacccctgtttaaaatcttcttaatctatagccatttctcctcttcttttttccccctttgccatttatttgtttaaaaaagtcatatcatttgccctatacaacttctcatattctgcatttgactgattacatctatttatttatttatttacttttcttagatggagtctcgttctgttgcccaggctgctggagtgcagtggtgtgatcttggctcactgcaacgtccacctccagggttcaagctattctcctgcctcagcctcctgagtagctgggactacaggcgcatgccaccacgcctggctaattttcgtatttttagtagagatggggtttcaccatgttggccaggctggtcttgaactcctgacctccagtgatcaacctgcctcagcctcccaaagtgctgggattacaggcatgagccactgtgcctggcccagtttttccaatatttaaacaaccaacctgtgctatagcaagtttcccagtcaaggattcatttatgttcaagcatgctacttataaaataatacagtatattgatccatttataaaattatgcaatatattgattcattttagaatttcctttaaaggctttcttgggtgactaccaattaaccaaaattaattacgttatcccaatgaccaaattaatcccctggtcaaattgaactggatacatgagttatgtgaaaaaccttccaggggttttcacatgtactgatgtttttgttttgtttttttttgtttttgtttttgtttgagatggagtctcaaacaaaactccagtttcccaggctggaatgcaatggcatgatgtcgactcactgcaacctctacctcctgggttcaaagattctcctgcctcggcctcctgagtagctgggattacagctgcccaccaccatacccggctaatttttaaaaatatttttagtagagacaggatttcaccatgttggccaggctgatcttgaactcttgacctcaggtgatccacctgcctcggcctccccaagtactgggattacaggcatgagccactgcgcctggccgtactgatgtttttgattctctggttatacttgaggtagagtaaatgattctaaccagcactggaaccattaaaggaatgtagggcctcgtcagtattagttggttggagaggggaaggaagttaggaccaggcaggaatgagtgggtggagaaactgactcagccgtttggttggcttctaggcatgggaattcagcggagggagccagacctcctatgcatatgatggtagcaagagtagccctcattttattcctgccctttctaatcaggataggcttaggacatgagcagtgggatgtttagtgacatcggcaatgaaggactaggaaatacagactttgatttattttttaagtgattctccatcagctgtgtgcttttaagactagactatgggtttttttgttttgttttgtttttgagactgggtctcattctgtcacccaggctggagttactgtggtgcaaccatagttcattgccacttcaaactctgggactcaagtgatcctctcacctcagcctcttgagtagctgggactacaggtgtgtgccaccacatccagctaattttaaaattttttgtggatacgggatctctgtatgttggcctggctggtagactgtgtttttatttgaatatttgtaccaaaacttaacattctgctgcttattgattatattttactacctaagaaaataaatatgtattatttttaattggcttatataaaacataatacctgttttcttgtagcttttaagtaaaatttgaagcattagatttttaagtgtaggttctttaggttctttttttttttttttgagacggggttttgctcttgttactcaggctggagtgcaatggatcacggctcactgcagcctcgcctcccaggttcaagcgattctcctgcctcagcctcccgagtagctgggactacagaggtgtgccaccatgcccggctaatttttgcatttttagtagagacagagtttcaccatgttggtcaggctggtcttgaactcttgacctcaaatgatccacccccctcggcttcccaaagtgctgggattataggcataagccaccactcccggccaagtatagcttattttcttatttgtaatttattaaagccaaagacaccaagattgaaagcaactgaaaatgaaaatgatatttccggggaggctaataacttacggagctttcctgtggcctcagggtcattgttctctgttagccaatccttagaaattgctagaactcataggaatgcagagttgtatgatgagaagaacaagaacttgggtttcagggagatcagggtaaccttgggcaaggtctctgagtctaggttcccttatctgtaaaatgtctcatgaagtcatgtgagagttaattgttataaagcttggccactcgaaggggcttaatgaatgtgagttatcttcctttctcccagtcctgattttgcaaacctacctactccgtgtttctgctaatcaccagaatgaaacttaaaaaaaaaaagaaaaagctgatggtttaatcttgattttcagtgtcagttaagcataaaataattctattgttttcttatgtgcataaggcttaactttcattggtttttgatgatctctgcatgttatatatggtacatattaaatatagtggccatatttttttttaatttcttttataatatttttttcgagatggagtctagctctgtctcccaggctggagtgcagtggcgtaatcttggctcactgcagcctcagcctccgcctcctgggttcaagcaattctcctgcctcagcctccccagtatctgggactacaggcatgcgccacaatacccagctaatttttgtatttttagtagagacagggtttcaccacgttggccagactggtctcgaactcctgacctcaagtgataggcccacctcaccctcccaaagtgctgggattacaggcgtgagccactgtgcccagcagctatattttataaaccaaaaaattgggacttgtggtgtgataagtatagtatacttaggaaggttaggagaacagaatattttgaagaagtgcactctcagagaaatggtcgctgtgcttttatgtattcataaggaagcagtacaaagttgtggttaggaatgaggccctagagtcctttggacatgaattcacatcttggcccaggcactttctacttactgcacaatatacttaacctttctaagcttcagagcttcctcacttgtaaagtggatattatgagagttccttgtttcttgtgaggattgcatgaaataaagggctcagcacagtcttggcagatagaacttaacatgtaaatgtcagctgttatgtttattactgtaaagcctttgatacgtgcacacttatacagtaaactttttttttttttgcaaaaacctgttcaaaaagcacttctaaaataactcaatatttgcaaacttactctatagtaagttctttatcaggcctcgtacagaaagggcacagaaatattttgaagaccgcatgccctgtcttgcatgcccactgggaagacctgactgactttggccttctcaaaatatttgcataactctcagcacctactccattgcttctgagatgacctctgcaacgtgtatatgttttggctgatacagccaaacttgtcctggacagacttcaaggttcacttaatctactgtcacaggcttctttccctaagattttcttggttgtgccctccctagagtattggcttcttcctcaggctagcagcaaaatagctgcagtaggcctaggccccagatttatgtatggcacccacctaaggaatagaaagattgtcttggctgggcgcggtggcttacacccgtaaaatacctgtaatcccagcactgtgggaagccgaggcgggtggatcacctgaggtcaggaattcgagaccagcctgaccaacatggtgaaaccccgtctctactaaaaatacaaaaaattagccgtgtgtgatggtagacgcctgtagtcccagctactcgggaggctgaggcaggagaatcgcttgaacctgggaggtggaggttgcagtgagctgaggtcacaccactgcactccgacctgggcaacaagagcaaaactccgcctcaaaaaaaaaaaaaaaaaagattgttccttagagtgagaatttttctcagaagcctccagagaactaccctagaatctcattggcctggactgggtcatatgctcattcctgagccaatttttgttagtagggcaatgtgatgccctgatgggcttaggcctggttcttgaacaagccatttacaagagggatgaaattatctctagaccattcagaaacagaattgtgtttctgttaggaaaatttttttttttctatgagtaggtgaatggacgctgagtagattggtcgaagaggaattgtgttggctgctgataacagtgctttaaagaagacaggttatttttctctcaaaaaatattaagtccaaagtagatagtctgttcctggcatggcagttccacagtgccatcaggcagcctagatctttctctctttctgtttcaccatgcttatcacacagcttgcagtcaccaagtggtcgcacgtgttggctctggctctctagccaaacggtctttgaggcaggaagaagtaggaaaggggagggcagaggacaccctttaaagtaccctaagtcccaaccaccatgttcagtttacatctcattgtccattcttacttgtgaagaaggctggtaaatgcagtttcttagctgtacacattgccattccccaaaacagggattctgcagctgtggaagaatgagaaatagatacaagcctggaagtgggcagtgcccaccacaggaggcggccaacaatgtcagctataccctgtatttggagaaaattgcagtttttacattgactttcctctttcttttcttttcttttctttctttctttccttccttctttcttttttttttttttttttttttttttttgagatggaatcttgctctgtggcctgagctggagtacggtggcacaatcttggttcactacaacctccacctcctgggttcaagcaattcccctgcctcagcttctggagtagctaggattacaggcgtgccccaccatgcccagctaatttttgtatttttagtagagacagggttttgccatgttggccaggccagtctcgaactcctgacctcaggtgatccacccaccttggcctcccaaagtgctggggttacaggtgtgagccactgcgcctgcaatgcccggcctgcattataaatatttgttcataatgtgttgctaacagtgacaatcaataagaatcaactgggtttgttccccagcctgtttagttttattattgtgattacaaaataattaaatattatgttaaccaatgaaatgtaaagggaaaaaggaaaaaagatactgcttttatgaaaaataagttgaatgtgcttacctgataaaggcaaatggctaagaaaaaatatttttgtcaaattaggggtggaagagacctctgaaaagattgaagaaaaaaattataaaaatatggagattctgacagatagggtaactctcacctgtaatcctagcactgggaggctgaggcaggaagattacttgaggccaggagtttgagaccaatctgggcaacagtgagaccccgtctctacaaaaagaaaattagccagatgtggtggtgtgtccctgtagtcctagctacttgggaggctgaagtgggaggatcacttaagcccaggagtttgaagttacagtgaactatcatcacgccactgtacttactccagcctgggacacagagtaagaccctgtctccaaaacatatatatacatatatgtttctgccttcagaacacttcacaagtatcattccagtaaaaactgaaaatcatagatgtacatcatgagtgtagttcatgcagaaactttaattgcttgaacttactctcaagaaaaggccttcactgggcacagtggctcatgtctataatcccagcactttgggaggctgaggcaggtggattacttgagtccaggagttcgagacacaagcctgggaaatacagcaaaaccctgtctctacaaaaaatacaaaaattagcaggttgtggtggtgcatgcctgtactcccaactactcggaggctgaggtgggagaatcacctgagcccagggaggttgaggctgcagtgagccatgatcatgccattgcagtccagcatgggtgacagggagagaccctgtctcagagaagagaaggagaggagagaggagaggagaggctttcatcccttagccagtatttggaaaataaacatgcatttttaatgattcctctctttaactgtattttttaaaaaatgagttataccattattagttctgattccatcaaggagagaacttctactttgtttcttaagttgttatgtatgggttactgtgtatcaattgaaatgaatatcaccaggccttattgttggtcattataaattgtgccctggtgaacttctttccagagacatcttctctagtatattttttgtttttttgagttcttttttttttgagacagagtcttactttgttgcttatgctggagtgcaatggtacaatcttggatcactgtagcctctaccttcccagttcaggcgattctcctgcctcagccccccgggtagctgggactacaggcatgcaccaccactcccggctaatttttgtatttttagtagaaacggggtttcaccatgttgaccaggttggtctcgagctcctgacctcaggtaattccacccgtctcagcgtcccaaagtgctgggattacagatatgagccactgcacccaggcccctcactgattttaaataatgtgaagtttggaatgtctcagggagttcaatgtaatggaatttgtcctgatgttatttctttttccaaatcacatagcacttcaaacttttctttttataacatttctcataaatagtcctcctccataattacctttgtgtttattttgtgtctgctactaaactcttagcttgttgaggacaggagtccttccttggacctctgtacatcctaacatacaatgggtgctcaatttatgttcatggaatgagagaatgaatcaatgtcactgtcttctattattgcatagacatcttcagtaacacttcctttgaattcattgtcagtggagctagtcttgtagccttttcaatagcttacattccgtgttggagcaaaaaatgttaaatgtttataaggtaatttcaaatataagcaaaagtagagagaatggtataaagaaacctccattatctataatcaagcttcaacaattaccagcattttagagcaaattttgatttaggataagggtagagagaatatgatgacatcaggatgctgattttgattttgtggggagagaagcaggccatgtgtggtgagcagggtagagaaagaggaggctggtggcccaaatacaaacctgcctcataggagttgtcttgaggatcacttgagttgacataggaaagtgggaagaacaatgcctcacacatggtgagtacagcctaagtgctcccaccaccattactatcactcctgcgtagtttgtgggagctgaatgtgggagctgtggcacttactaacttggtgactttggacaccgacctttctgagctgcagtttcttcgtcggaaaaaatgggaatagtaataacatcttaaacatagcattggcggggcgcggttgctcattcctgtaatcccagcagtttgggaggccaaggtgggcggatcatttcaattcaggaatttgagaccagcctaaccaacatggtgttggttttaatggagaaccctgttctccattaaaaataggctgggcatggtggctcatgacttgtaattccagcactttgagaggctgaggcaggcggatcactggagatcaggagttcgagatcagcctggccaacatggtgaaacctcgtctctactaaaaatacaaaaaattagccgggtgtggtgttgtgcacctgtaatcccagctactcaggatgctggggcaggagaattacttgaacttgggaggtggaggttgcagtgagccgagatcgcacaactgcactccagcctggatgatagagcaagactgtctagaaaaacaaaaaaacccaaaaaaggtagcatcttatcccacacaggcagtggaataatatatgtaaatatgttctgggttaattaacattaatcacaattttccagagtggttttctagtctggagggagggaccatgtttctggaggttttttcgggagtcaagccaattccttctgtgtattctcattctgagacttcataatattcgtggcagagtcatttgtcagcctagcaaataaacattacaggacaataggctttgtttccgtttgcaaaatgttttttaaataatgaaaacaattttactttatgtagcttgtccatatatgcactgaaaatgaaatacttatcaaccaagttgataaagggataaaaatagttttcctaaggaaaactatttgctggggatttgtgttggacaagttttgtagcagtctgtttccccgtctttgaaatataaacagcatctttatttgtctagattttgcttataacaatttgctcaactcctaattaaagatagctctgtcatccacacatcacttagctactttcctaaagccagaatttctttagaaaatcagttttcttttaagacttcaaaacactttgccttctccttagtactataaagaattctaattatgtaggacattcatccagccactcctcccaccacacacacacacacacacacacacacacacacacacacacacacacacatatatctgtctgagataataattagatactgtgggaagagaaatgaaatatccctgatggttttaataattttctgcagtgtttgtttggacaagaaaatcagctgtcacatcccctgggtatgagagttatataaacccagatcagaaagtcaatgctgcagacttaaattctcaggaagttttaaaacttttaaaactaccacttgccttttggatttgactttttaaaagtttgatttttgctttttcagatactaaacttttggcattcttagtatttgtgatttatagcatcttgtacttttatagacttacttattcaaacaaactaaacccccactctatgcccagataacaaaaaaacacgtacaagatacagttttatctcaaaatgagcaatatcctgaagctatcatttggtcccagtgacatatgaactgttcgtttttttccccatatactgttctgtgtaaatgttctattacacagtctttttttctggattatttttctggagatttcgttatactttgttgatgtttcttttcaaaagctcccgcacaaatcatctccagtagtcatccagccagtgttgtactagaagatgtgttacttctaatttaaacttccatttaaggcttgacgctgtggctcacacctataatcgcagcactttgggaggccaaggcaggaggatcacttgagcccaggagttcaagaccagcctgggcaacaaagtaaaaccccatctctacgaaaaatggaaaaaaatagctgacatggtatcacatgcttgtagtctcagctacttgggaggctgaggtgcgaagatggcttgagcccgggaggtagaagctgcagtgagctgtgtttgccccactgcaccccagcctgggtaacagcatgagatcttttctcaaaagaaaacaaacttccatttgagaaagtgacagaaaagttttggatttttgtaattataggaattctttacttttctttgataatattatatctctttcagtgaaaagggagttaggaagagatctaaatgtactctttgatcttccttgttaatcatttaaaaatggaattcggagctaattttaacttctgaaggacctgggggaattttatctagcacctgaggtataccttagttttttatgtattgaatctttaggaccagttttattctttcatttaaatatgtagtgagcatctagtatgtgcttaccattgtgctgtgtgtttatatatattatctcatttaattctcacacaagcgttgttagatacataaaaggggacttcaaaaaattcatggaaaaaattgaattaaaagataaaaatgaaaaatataaactttatttctcaatataaactccatcaagttcaaggcaatattgtagtgatgataccggccatttagcccgtccctaaagaactgagggttctggaaatttagccatattaatgcagtcttttttacattattaactgaaaaaaaaaatggattccctttaaagatttcttaagattaggaaacaaaaagaagtcagaaagagccaaatcaggactgtaaggtggatgcataatgatttctgtgcacagtgatttcccattgaaatctcgcaaaaattgcccttgtttgataaaaggaatgagcaggaggagtgttgtcatggtggagaaggactctggtgaagctttcccaggcgtttttgtgctaaagctttggccactgtgcccagccacaactttcattttgttaagtcatctaatccttacaactgctccatgaaataggtactattattatccttatgttacagatggagaaactgaggcagagagcgggacagtaacctgcctaaggtcccagagctctagagtcagtggtcttaacctctattatgacctctcacttaatgagggccagatttcccctctagctttttattatgaaaaatttcaaatgtggaaaaaaattaacaagagtacaatgagcacctgtatcaaaaacctagcccaaacaattgttaacattttgctgcatatagtttatctgcatgtgtgtatttcaattttttgctgaactatttgaaaatatattatggacattataattcactccttaaatacaaaacaaagcaacattttcctgttttttttttgagacggagtcttgctctgtcgcccaggctggagtgcagtgatgctcactgcaagcttcgcctcccgggttcacaccactctcctgcctcagcctccccagcagctgggactacaggcacacgccgccacgcctggctaatttttttgtatttttagtagagacggggtttcaccgtgttagccaggatagtcttgatctcctgaccttgtgatctgcccacctcggcctcccaaagtgctgggattacaggcgtgagccaccgcgcccggcccaacattttccttttacttggtaaatgcattcttggaaaatacattgcctctaaaatcatgcaaaagtactttgctacagacaaaaaggagtggagttctaggttcagataactgtaaagagctttacatgagtatcttgatatttaaaaatcaagcagagtaaagggacaatttttgtttctataagacagcccctcaatttgctggatgtttaacatcttggtctctacctactaaatgcccatttgaatgaggagacaattgactgttgtgtcaaccaaaaaatgcctcccatcccctccgtttccagaaagtcctctagccagctgtgcctgttgagtgtcattgacttgactggtcttctgctgaaggagctataggttaaattaaaataaaatgtgctgtcacagaatccttatcatcatgattcagagttgaggtaataaaggtggtagaacttatctgtaattctcctttagttctacaaccacatatgctctagatttgtaaacaaatattcatttattctgttgtattctaccaccaccactttgttccacaaaaggttatacagcagatttttatttatttaaccattaagagtgtctccccgtgtattggaatcggctaggaaatattcgtaattgctacacttttctatataaaaagggacttgaagcagactcagggccaacacaatgtagaatctgtttcttctagctttatttctccctgtgctgctagaggtaccaaagggtttgtctcaactgttactacccctgacatattccattgatctctttacttttctctgttgtctgtcagtctgtttgtcagacttatctcaaatgccacgttgtttgcgcgtatttctcaaagccatccatcaggatacaatctaaatcatcacagcacattctgtcttgtgacactaagcacagactgcctgtgttacatttgattgtgtgtttcccttttcttccacatatgtttcagtagtaatttcctgggcaacttatgtgtggcgggccttgtttgggatcttggaaatagagagatgaagctctcctacatagtctcatttacttccaattttgctttcttgataattggagtagccttttctagcttgtatcccctgcagtacctgatgcattgccttgctcagggtaattcatatatatttctgaattcagtttggaatgaaaggagacaagcaggcacttttgaatcaaatctggtgctgccactatgcaactgtatataaatctaacccaacccctgtgcgccaggttccttatctgtaaaacatggataataacaaccatcttacaggattgttgtaaagtttaaagatgaattgtatgaagcctagcagagttattggcacgtagtaggtgctcatgaagtagttgttattgtaagggaggttcagtcattcctttaggtcacttgagtgggcagtggaagcatttaggatcttaattgtctttagggaaatgcttacttagtctgggggcttctccgagaagcaggctctggggaaggtctggctcattgctgattaactgttccctttttagagtcaatgatctgagtctgtgttttggaaccacttatataatgtataccacctgttatttgtgtatttttagaagtgggagtcgggtaatcctagtcctgtcagtaaaagagcaaactgtttaccagaagcagagcttttttcttaacactgactcacactgactcatctttctcatttttcttcccaccgcctcataacaaccttgcaagagagagaatttttagggaatcagttgacttacttttttgtgattttccaaagttgaaagcttgaaggtatcaggtcattaattccatcccaggaaaggctaaagtttatgctgcctcggagtgccagtatgaccaacgccatgtagtgaatatctcacataaacccttgtctagacaaaccacttctgttggctgagaggttagacaagtgcctgaagtgtacatgttaagagtaaacacattttgctctttgaaaatggttgccttaagttgaacctggaaagtttgctcttctgagataggaaacccaagcagtattagagtcagagctgtggtagcttcacagatggatttcagataacagagaggccagacagcacattagatcagcaaaatggtgaaggaagctttatagatcagaatgactgatatctttgtgccttcatttaacattcattaaatgaacatttactgatcatctgtgatatacttggtgctagggttatgacagtgactaataaaaacatagtgcctgctgtcatggaccttatactctaatgctcgtttatagtaaatgctaagggaacagagagatgccttggcctgcatatgtgaacatgttcctgtgcacacgggtgaggggaggaaggaaggctccttggaggaaaaggcacccaagctgagtctggtggggtgagtaggcattaactaggagaaaagggttagttaggggaatgtggggttggctgaagagtattacatgctgaaatgagctatgagtcttggggtcgagagaagagcttgcccttggagaagctgaaaaaagtgaccaaaggacagtgagagggaagtttggcacaaaataaattcagagaagctaacagtgacagcagagcattgtagaccagtttattaatttaaaaaaaaatttttttttttttgagacagaatcttgctctgtcgcccaggctggagtgctgtgatatgatctcaatctcagttcactgcaacctctgcctcgcaggctcaagcaattctcgtgcctcagccttcccagtacctgggattacaggcacacaccaccatgcctggctaattttttttttgtatttttagtagagacagggtttcaccatgttggtcaggctggtctcgaactccggcctcaagtgattcacccacctcagcctcccaaagtgctaggattataagtgtgagccactgtgcaaggcctaaaaaattttttaatccagataaatttaacatatagtgaaatgctcatgacaaatgcatatacctatgtaaccaacaccccattttgagtaggaacttttaacttggtagtcagagcaaggggaaggatgggtttttgagcagggtccagacttgatgctaattgctagctaagaactgggacaagggtgagggggtgagggggtggcaagtaccagtggggacagagctggaataggcagtagtttgctggtgggcaggagcttccagcttgggggcaaaaaacagattcttggttttcctaacttgtttttagcagaggacaaacctctaagtgctttgtaagatccaaagtgtctatgcagaagacaacagactgtgttttttcaaagattttctgggaagacttccaggctacctgcagtttgaagaaagtcttctgaaaagggcagggggcgtgggggcacctacagagacaggatttcccccaactcgataagatacaggaaaataatcatcttattgatttacttttgttctatagtaatgtgacattttttcttttctgagagtagggtattaaaaattgttacggttttgggttttacagatttgttgaagcttaatatcatttaagtgtcctattttaatatctgttttaatatctgtatttttgacagactgccagaaatcatttaacatgttactgtgctatttttgttgatgttgtcattattatttttgttgatgttattcttaaagaaaaaagaaaagatactatcgatagaattatcgtcagtattagaaattaagaaatgttttaatttcaattgaaaacaaacaagtaaacaaacatgaaaatgtattgagagatgtgtgtattctctacctttgttttattccttttacaaaaactataaggaatagtgcttaacagtgtactgtcaaaacactgacatctatttacaggaagttcatttctgaccagaattgtttgtttgtctctccaaagcttgccaaattctataggttttatgtaagtttataaatattcttgtaaacattggctttaaactaaatccttctaaatatccaaactaccatgtatctttctgtgtctaaattcagagataccatcctgttggctttagataagttacagagtagtttaggcccacatgatttaagctcacccacagttctttgttgatacttgaggatttcatctgaaaagcatcctgttcatactctgaaaatatttctttcatcttagtactcccactcattttgtgtgtgtatatgtgtatagattattttattgttccacatatatgtatatttattttttgtccacttgctagggaacctcattttttttaacaagaaaatacttgtgtgataaggtcataaaacccaagagttgggaggaatattagagacctactttatttattttattttattttatttttttgagacggagtctcgctgtgtcacccaggctggaatagtgcaatggcgtgatctctgctcacggcaacttctgcctcccaggttcaggcgattctcctgcctcagcctcccaagtagctgggactacaggtgcgtgccaccatgcctggctaatttttgtatttttagtagaggcagggtttcaccctgttagccaggatggtctcgatctcctgaactcatgattcacccgccttggcctcccaaagtgctgggattacaggcatgagccaccacacccagcctagagacctaatttaaagtttattgctgctttattactctgaacaactacatcatttattacctaaaataatctttttattttctgttctcatttagctgaatctctgagcttaaaaaaagtgtgtttggcttatatatcacattatcccacatatgttacaaccaaaacttaattattagccataatagtgtcttttggctaatattagtagtaagatttttgtttgtttgtttgttttttgagatggagtctggttctgtcacccaggctggaatgcagtggcgcgatctcggctcactgcaacctctgcctcctgggttcaagtgattctcctgtctcagccttctgagtagctgggattacaagcgtgtgccaccatgcctggctaatttttgtatttttagtagagacggggtttcaccatgttggccacgctggtcttgaactcctgacctcaggtgatctgccccccttgtcctctcaaagtgctgggattacaggcatgagccaccgcgcctggccaatagtagtaagttaatgaagatctgtactaaatttggattccaagtgaaacatttctttttttcttttttatttatggcagagtagagggttgatagatatttgttggctttattagttttctcaaattggtatgtaaaaataatactagatatataggtttaagtctccttcataagattttctttcttctaaacctttggaatatgccatgcttttcaaaaagccccactcattatttttatgatagtggaataaaagtctccaatttgtcaagctcattattcaagccttccaggattgtttgcagttttaaaataaactgctgggggttttatgcatcttgcaatatgagtacttaattaaaattaaaaagggggccatgcatctatctattctattaaggtcgtatataaataaatgattttattgggattttcagtgtatttagagtaatctatacttaatgagagggacttgtacttttcatttctttgtactatttttcagcctttcctgaacagtaaatgttttaaaaaaaactatacccttattccttggtctctaagaactgtggtgggctgggcgcggtggctcacccctgtaatcccagcacttcgggaggcaaaggaaggtgggtcacttgacaaggtcaggagttggagaccagcctggccaacgtggtggaacctcgtctccactaaaaagacaaaaattagctggtgtggtggcgagcgcctgtagtcccagctactcgggaggttgctgcaggggaattgcgtgaacctgggaggcagaggttgctgtgagccgagatcgcaccactgcactccagctgggtgacaggtgacaggtgacaaaaaaaaaaaaaaaaaaggccaggtgcggtggcttacgcctgtaatcccaacactttgggaggctgaggtgggtggatcacaaggtcaggagatagagaccatcctggctaacacaatgaaacactgtctctactaaaaaaaaaaaaaaaaaattagccagccgtggtggcgggcacctgtagtcccagctgctcaggaggctgaggcaggagaatggcgtgaacctggcaggtggagcttgcagtgagtgaagatcacgccactgcactccagcctgggtggcagagcaagactccatctcaaaaaataaaaaataataaaaaaaaaagctgtggtggagtatatggtacaaacatgagacttggtgctcttttggattcctaaggcttttccatgtctgagaactcaggaggcagcctttgcatagcagagggactaggaacctcactatttctccaaagttgactagctttctataagataacccccataaaatcactagtcattagtaataaaactttgtctttaaatgactataatatttttaaaaaggacaatgaatatgtactctatgccatccctttccatactgtaaatgtgtttctgaaaggtatgctatttagatatacttgagtcctattctaatatacggagaggttgctttttaaattgtcctcatcattgtggtagtaatagtaatattagtagtactggtagttaacatttatggaacacttcatatattttacatacatagcttcctttaacccttataataatcctatgagttaggcattttattctctccattttgtgggtgggagaactgagacttgatatgtggactatatgattgatcgattggttgattttggtaaagttcagatatcttttgtcctgtgcttgacactctaaaatagtaagtatttgggtaacaaataattgtaagagagagaaaatcatcttatcttttggactattcccttctattccattcctactgccaacactccagtccaacctcacatttctttttctttctttttttcttttttctttctttctttctttctttctttctttctttctttctcattctttctttttcattctttctttttttctttctccttccttccttcctctctctctttctttctttctctttttctctctcttctctttctttcttcccttctttcccttccttcccttccttcctttcttttcattttctttctttctttcttacagggtcttgctctgttgcccaggctggagtgcagtggcatgatgacagctcactgcagcctccacctccacagctcaagtgatgctcctgcctcagtctcccaagtagctgggactataaatgcgtgccactgtgcccagctaataaagctccttctgctgaagttatgcctaaacccttctttgcacatgtcattccttatcacttatcacctaaagaatgacagggggctttggctttgaatggccctcagtatgtataagcacctaaagatttcagtttatctcagcttcagagcagtccatctcatctgcctgtttttcttcttaaaataaacttttaaaaaataattaaagtttttaaaaggtgcagaatatttaagtaagatttcttctcccctttcccctaaatctccattctcatttcgtagaagtaaaccattcttaacaatttcctggataattcttccagaaattatgcatgtccaaacataaatataaaatctattggttgcttaaaaaatctataaatgagatcatattatacaaactattctactgctattgttcacatagatacattttattcttttaaatgacttcatggttgtatcacttacaaaccttttggctttgagtaacagaagcagggaatgtacagaaggggtgtcagacaaggcttccaaattatcagaaccaaggcaggccagggaatcatcatcctgttttagctgaagcagccaggccagtatgttgccatcactgcccttggacactgtcaggaataaattccaactgttcctttgtcatagtgtcattttttaaggttcagagtcccagtgagactatgcacaatggggaagtacccccaaatagaaagaagtgactggatgttggaaaacttaaaaaatgatacatttccattacattggtattctattgtataaacatgccataatttatgtattaataactagccacttcttggtgaatattcagattgtcatattcaattttttactagcaaaaaccactgctgcaaagaaaattatttatgtctttgtgcatttttgtaagtatatctgtgagattaatttcaagaagactgtgctggatcagagagtatgtatatttaacattttgatgtagcgccgggcatggtggctcatgcctgtaattccaaaactgagaggctgaggtgggcggatcacttgagctcatgagttccagaccagcctgggcaacatttttttcatgggcaaaacccggagaagaaaatatgaaaaaaatacaaaaaaaaaaagaaagaaggaaagaaaaaagaaaattagctgggcatggtgttgcacacctgtagttccagctactcaggaggctgaggtgggaggatggtttgagctggggaggcggaggttgcagtgaccagagattgtgccactgcacaggagcctaggtgatagagccagaccttgtctctaaataaataaataaataaataaataaataaataccattgtgatgtatattgtaattcatgcttagaagctttcactggtttacactcccatctacaaagtgaactggcttttaacttacaagatacaaagttatttatggccatatattcagcaaaagccacaaagtgtcacaccaggtgaaaagggaagtccaagtttctgaggtatagagtttcagtatttatcaggtaagcatagctaccaaagccatttttgttctggaagcatttgctgatcccgagaaagcattttttaggttaagctgtatttttggtgtcttcatatatgaggacagaattcttagcttgttgtccgtcaaggatggggaatcagataaaccacttttttagtttgaatggaacccctaagggcataagagggaacttgaactaagccaaccctcacaatagccttgccaccaagcttctaggtgtagggaatgtagaccaagatctttcatcattatggttctcaagtaataatgccatcaggcagctggcagaagcaaatgcaaattttctctcgaggaagatgttatcatcccggacatcaaaatagtcctctaaataattttttatgtaatcactagcacatgggattaaaaccaggttcacaaagaaataagataccatgaaaagaattagcaaaagccatatacaacaaaagtatcaaagccatgagatactggaatttcagatgcagaatgtaaaacactgtatttactatgcaaaaagaaatagaagccaagataaaaacgtcacaatgggccgggtgtgatggctcacgcctgtaatcccagccctttgggaggcctaggcaggtggatcaccaggtcaggaattcaagaccagcctgaccaacatagtgaaaccccatctctactaaaaatacaaaaaattagctggatgtggtggcgggcgcctgtgatctcagctacttgagaggctgaggcaggagaatcgcttgaacccgggaggcagaagttgcagtgagccgagatcgcaccagtgtattccagcctgggtgacagtgcgagactccgtctcaaaaaaaaaaagtcagtaagtagacactgtcaaaagtgacagcagatttgaaaaaatccaaatagacattctagaaccaaaacatataataatcaaaaacaagaatgcagtggatgtatttaaagtagattacctagcaagagagaactagtgaactagaagatagaagaaaattctccagaataaaccttcaagagatttaaaaaatgtaaaatatagaaaagatgattagagaattaaaacgatccagtgacaagttctaatatgcatttaaaaaaatttttttttcaagttttttcttgctgcagtgtccaggctgaagtgcagtggctattcccaggtgagatcatggcacactgtggcctcaaacttctggcctcaagtgatcctcccacctcaggtaaataggtgggactgcgcccagctttaatatacatttaattagaattacaaaatgagtggagcaagaatggtgcagaagcaatatttgaagagataattgatgatcattttctagaactgcagaaagatgaatttgcagattcaaaagtgtatagccttaaagaaaagctaaaagctaaaaactgagcaagcatccatcttgtaagtcagatcacattttgtaagtcagagaaaacacagcaaaataattctgaagaagataaagagaagctaggcatggtggtgcatgcctgtagtccaagctgcttggaaggctgcaatgggaagattgcttgagttggaggccagcctgggcagcatagtgagaccccacctaccctgtctctaaaagaaagaaaataaagggaaagaaagaatgaaaagagtagaagttatgaagtataaagcaaatgtatagcagggaaaatcaatgaagccaaagtatgattcttagaaaagattaataaaaatgataatactctgattaggttgatcaagaaaaggaagacagaaataaagaaaggagcacaaataaccaaaatcaagaatgaaaaagagggggctgggcccagcctttaatcccagtactttgggggaccgaggcgggcaaatcacttgagctccggagtttgagaccagcctgggcaacatggccaaacgccatctctacaaaaattagccaggtgtggtggtgtgtgcctgtagtcccagccactcaggatgctgaggtgggaggatggcttgagtcttggagggggaggctgcagtgagcctagatcgtgccactgcactccagcctaggggacacagtgagaccctgtctcaaaaaaaaaaaaaaaaaaagagtgcttaaaaaaaaagagtgaaaaagggagatagtatactcattaacaaaataatgatactatgaatactatgaataattttaaaccaaaattttgaaaatttagatgaatggataaatttattagtaatataactattaataaaaatggagtcatctgggcatggtggctcacgcctgtaatcccaccactttgggaggccaaggcaggaggatcacctaaggtcagaagttcgagaccagtctggccaacatggcgaaaccccatctctactaaaaatacaaaaattagctgggcgtggtggcctgtgccagctgcttgggagactgaagcaggagaatcgcttgaacccaggaggcggaggttgcagtgagtggagatcgtgccattgcactccagtctggttgaaagaatgagactccatttaaaaaaaaacagaaaccaaatggaatcagcagttaaactcttcccttaaagaagactactagcccatcactaggagtctaccaagcacttaagagaaagaattaatattacacaaatgcttcctgagaatagaaagagattagcaaaacaaaaaacctgacagtgacattatgagaaaggaaaaatcataagcccttttactcaggaaaatttctacattttactatgaaaaattcccaactatatattagcagagcacaatccaatattttacttattattgtagtataacaaactaccaaagttttgtggcttagaacaactgattttttttttttccagagattctgtgggtcggaagtttggactgggcacaacaaggatggtttgtttctgtttttgtctaggttcccagctgggaagactcataggagggcttggaatcaagcccttggcttgttgatctttgtcgtgtcaatttcttgtttttcttttttctgagacaggatcttgctctcttgcccaggctagagtacagtggcataatcatagctcattgtagcctcagcctcctgggctcaagcgatcctcctaccgcagcctcctgagtggctgtgactacaggcacatgccaccacaccttgctaatttttgtatttttttgtagagatgaggtcttactgtgttgcccagactggtctaaaactcctggactcacgtgatccttccacctcagcctcccaaagtgctgggattacaggcatgagccactgcacctggctgtctgtcttaccagtttctaaaatctctttatgggttaaggaaataagctatttatattgataggaaatataatttcctctagcctgacatttgatttttattttgctgatcatgctttttgccatgcagaatatttttatacatagtcaaatttattaatatttcctttaatgacttctggattttatatcatagtacttggaaataccttctccattgtgaggtcataaaatatgccatgtgtttttccagtgcttttatggtttcatatttttacatttggatttgtggatcctccaggagctatttttggggtgaggtaaaagactacttattaacctcgcttttctcagtcagatggagagattaattttgactgtggagaagggggctctggtaaagtatcttgatcatctcttagggtatgggattgtgaggaattactctcttttcacccaaaggaattggaatgagcatctgaagtcaaaactgcctctcctctacagcaggtgggaaaaattgttttaaactgaatcctttttcactgttccttctcatttcctaagactttctgctaccgtggtatcactggcctcatgacatgttatgattttgatctcgtttttgtactattttagtgttttttttttctgatgtcatgaaaggacacagcttcattttatgtataagctctctctaaattgtgatatagtgttgagttactgtgaattctagccgttgttattattattttttttagagatggggtcttgctgtgttttccacagcgagaatcagagctcctgggctcaagcctcctgcctcagcctcttgagtatctgggactacaggtgttcccggctttagccattatttctaggatcagttttggagggctctcctttcttgttttgttgtttgatcccaagtccatctcaggcagtggtctttctgtaactttctataacactccattcatttattatattataagataggctgtgaatataggagaaaacagaccttcatgatcatgatttcacattcctatcattgttccagacatgtataaacctctcagacctttgaggcttagtctaagataagtcctttgaacaaccagtaaaaatcattaataaaaataaagaaaatcagcaattctttttcttcattaggacgtgttgaccttgatacgaatactactatgctacttgttcttggatgaatgataccaactttgacctgggcgcttatgaaaatattttaaagcatcacttaaaaattacctttctcaccattctaactaaagcaataggttttgtgtgttagtgggtttttttctaatgtctacttatgttcatttattaagcgccttctgtttgtcaggccttctgctagtgctgggactatagagttgaataaaatataaaattttccatctactaagggagatagaatataacaagtagttataatgtacagtgctgtgaactataatagaagtgttattgggggcatgtattggtcaggattcttagtagcaaacaacaaaattcactgtagttggcataagcagaaaggtagttttaacatctgtgcttggatgttacacagatgaaagtgaagcaatcacagacaatatttccatgagaaatggtcaaccccactaagggggactcttctagagaaaacaccactgctgcctttaccagcactggtgacatcagatactggacatcagaaactgtcccataacagtcctagaacatgggcttataattttctttacgttttctagtgcagttagatgcagttagcccattcataatctttatatccttcatgcccttcattggtctatagcaactactactgggtttgaaatagccctgactttaatatggactttacctcaggcaatcataggtgattattttattatttatttagagacagagtattgctctgtcgcccaggctggagtgcagtggcacgatctcggctcactacaacctccgcctcccgggttcaagcaattctccctcctcagcctctcgcgtagctgggattataggcacccgccttcatgctcggctaatttttgtatttttgtagagatggggtttcaccatgttggctaggctggtctcgaactcctgacctcaggtgatctgcccaccttggcctcccaaagcactgggattacaggcgtgagccaccacacccagccaataggtgattattttaaaactcttacaacattgcatgccactaactacccgcatctcattctctaagacagagattgggaaactatggcctgcaggcaaaatccagcctgccacttgtttttgtaaataattagttttattggaatacagctatgttcattttgtttacacattgtgtgtggctgcttttgcactatagtggcagagttgagtagttaccacagagaccacaaagcctgaagtacttactgtctatccacttacagaaaaagcagaaaaagtttactagccgctgttgtaatgcttattaaattctctctgccttttaagtccagcaggtgaggtaaatcagtttctttcaaactttttgactttgaaaataagatgcacaatttatattatgactcatgcatgcatatcatatattatatgtaaatgaaacattttcttcttttcattctattctataccgtttcatgttttgaaaagtatgctagtcccagctgggcatggtggctcatgcctgtaattccagcactttgggaggccgaggcaggcagatcacttaaggccaggggttcgagaccagcctggccaacatggcgaaatcccgtctctactaaaaatacaaaaattagctggatgtggtggtgcacacttgtaatcccagctactcgggaggctttggcaggagaattgcttgaacccagaaggtagaggttacagtgagccaagattgtactactgtacttcagcctgggtgacagaccaagactgtctctaaataaataaataaaaataaaaatatgctagtcccagtctactaaattgatttcatgttccacaaatcagttgtaacccataggtacatgaataggcatgttccattcatgaattatccaagatctgtttcatttccttaggagttttgtctgcattcccttctggtttccattactcaatctgtcaggattctcaggtgctactaacaataagtgtctgctccagctggtttaagcagaaaagcatttcttaaaaaaaagtagggatcttacagaatcttatagagggccagataacagatcctagtgctacctagatggcagttaagcagcaaatgaaatgcaggctggggaaagccatctaactacaccatgagacttccctagagaaaaccctattcctgccattgcgcagcacctgtgaccctagggtctggctaccagatatcctgcaaggtcagccccgtaagaactcagtctctgtgattgtctcaccaaagctccttgaaggagggctctcctggctcaggagctcagaggctgctcagggcatttctaccttttggaatcctgcttcattttcatctcgctgttctaaaactcctaatttttcttctcctattttattttccttttcttcagctatctactttgctcctttccttctccttttcctttatcctcatactcatcttggccattcctatcatcaggtggcgtaactcaaggctgaggtccctgaacagagcttagagctcatttcttcccactttcagtgtaccttcaacggcttttctagctactcctcattgaggttgtccagcttgtgtttcttgtgcaccttccagtgccgggcacaggctgggcagcacaccttctgggccaggcccaggattaagaacaggagcagggccctagagactgagactgttcccggctgacagagtgtggcttatgtctctcttcaccatttttaatggccagacaatgtgtttgatattttgattatttctattatttcactattataaataactctgcctgtaatcccagcactttgggaggctgaggctggcagatcgcctgagcccaggtgtttgagatcagcctgggcaacatggtgaacccccgtctcacaaaaaaaatacaaaatgagctaggcatggtggcgcatgcctgtagtcccagctattcaggaagctgaagtgggaggatcacctgagtctgggaggtcgaggctgcaccatgatcatgccactgcactcgagcctgggtgacagaatgagaccctgtctgaaaataaataaataaataactctgatataaatgtctctctcatttataagtcagtgtatgcacattttgtagcacttggtatgtattttccaaaggaacttaaaaataacttttcgtattttttctttttgtagaagtaatgctatattttagtgtaaaatactattttatagaaaaaatttaaaataccaataagaaaataaaaattacccacagtgtcatcatcctgatatgctactgattaatagtttcttccatttttttctactttccgttttacagacatgagccccttctacatataggggctcaccttaacattaaagtgagacttttttttttttgagacaaagtcttactctgtcgcctgggctggggtacagtggcacaacctctgccgcctggtttcaagtgattctcctgcctcagcctcacgagtagctgagattacaggcacctgccaccgcgcctggctaatttttgtaattttagtagagacggcgtttcaccatcttggccaggctggtcttgaactcctgaccttgtgatccacctgcctcagcctcccaaattgctgggattacagtcgtgagccactgcacctggctcttatgtgactattttttttaatgtcatcagatattcttcgatagtatcatttattgtgactgtgtaatattccattctgtagatttaccaaagtttatttaaccactgcctaatagtggactttaaggattttcagttttacagttttctgaacagtgctgaagtgaacaactttaagtcaagtctttgcacacacatctatagtggtttctcttggatagattcttagatgtaagatgagtgggtcagagagcatttacattttttaattaagaaactttattttttagaccagttgtaggttcccagtgaaactgcacagcaagtacagagaggtcccatgtcccccctacatttttaaggatttcagcacatatcgtcaaattgccctttaggaatgttgtaccgttttccattttcacctacattttctcatatctctgcaacactgagaaatatcatttaaaagaaatctttgataaggcacatgtctagtagaatacctattccagtcaagctaagactaaattttctctctcctgaaatttatatttacattattcagtccattattatttattgtggttagtgatcacacagttccaccaaccttccttctttggccaatttaacaaaaattataaaactaatacatagacacaaaaataaacattcagaacagaaagatatagcgatgaaagtaaaaaaaatccccacttgctttagccaggccttctgaaagcggtttgttttttactttaatgcttttttgtaattgtggtggttacttccaaaactgtaaataaaatatacataaacatgtaatttttattttttttgttattttattttgtcattttatttatttttttttgaggtggagttttactcttgttgcccaggctgcagtgcagtggcgcgatctcggctcactgcaacctcggcctcccgagttcaagagattctcctgcttcagcctcccaagtagctgggattacaggtgtgagccttgccatatcgcacactccccgtgtaatcctgctgtccagagatatacaatttggtgtattgtatatccttttagagatttaaatgtaggctgggctcagtggctcacgcctgtaatcccagcactgtgggaggccaaggcatgaggattacttgagaccagaagtttgagaccagcctggcgacacagtgagaccctgtctccacaggaaatgaaaaaaattagccaggaatggtggtgcatgcctgtagtcctagttattccagaggctgagttgtgggagaatcacttgagactaggagtttgaggttacagcgagctatgatgatatcactgcactcctgcctgagttacagtgcaagaccctgtctcgaatgaatcaataaatatatcagtaacaacaaaacatggactgtgagccaggtactatgcatagtctcattaaatcctcatagtgtctgagatgggggcccttgtttaccaaaacgtaaacttgaaccttatggctaactggtgacttgcctaaacatttccagtatttcctatgataagttgtatgcaataaataagatgtatctaattatgtgttcttgtgtgatcatctccatttaatacatttccacaactaggatggtttggtttaaaaagtgtgcacatttaaactatttaaacttttgtatcatcctgagggaggtagtttagagtgtggactttgtcgtcatacataccagtatttagattctgactgccacttactggccactcactaaaatgaaactgtacatcagtttacctatctctaaaatggaaggataacagaagcctcatatggctgtgaagattaaatgagatgctgctgcaatgtccctggctagtgtgcagcacctaggaagaatggtgtccaagacagaccaggcccctcatctcatagaactgatattttaatgtgggacaggaggaggcagcagtgaaaggcagtaaagaaatgaatgaacaacaaaaaaaagtggtgctgtatggacgcttaacagaaagtgacatgataggtagatgggtggttattttaggttgggtggcttgggaaagtttttctgaagaagtgacatctcagctaaggtctcagtgataaggatagttttataattcaaaaattcctagaaataaaaacatgggatcaaacattacatgcattaggccaggcaccgtggctcacgcctgtaattccagcactttgggaggccgaggcgagtggatcacttgaagccaggagttcgagaccagcctggccaacatggtgaaaccccgtctatactaaaaatacaaaaattaaccggatgtggtggtgcaggcctgtaatcccagctacttgggaggctgaggcaggagaattgcttaaacccaggaggcggaggttgcagtgagctgagatcgtgctctcactacagcctatgcgatagagagactcaaataataataataataataataataatgacaaaatgacctgaaaaaatttttaaataatttgcattctatgtatagacatgcctctttttctttaccattaccagaacttttttcctaatgtaaaaaaaaagtggggttgttcaaagattgtcttagggaccttctaatgagctttactggcagagggaaaagataagaaaatgtgtaagtcccttttaggaatctcttctatttcctctccctgtgttaattgtctaccatcatccattatactataaaccgttgtcttcactttactggcctttttctttacaccacatcctgcctacattgtaggactggaagctgccaacatgcatgttaactaacaagcactttttcgtctttagaattaggcagtgcctgggtcaggggagatgcaagattcagaacagcaatgcttttgctataaaaacaaggcagcttttagggtagactggtttttccaaacaaattcattgttaaggctgtaacacgttctgtgagttaaaactgtgcagaaggctctgcacatatgtttgttacagttgagcctttttcctgtatggcatgcaatgggggcaatgggcattggtgaacactgtacactaccattgcttccacaggtaataagacctcttgtttgtaacgtgtatatgattacatattgtggatctgttctgaaagcctttaatcatcgtagaaacgttctctttgtagggcttgagcaggcctcagcatctttacgacaatatacatgtttttgtttgtttgttttgagacggagtctcgctctgttgcccaggctggggtgcagtggcacaatctcagctcattacaacctctgcctcccgggttcaagcaattctcctgcctcagcctccccagtagccgggattacaggtgcccaccaccacacccggctaatttttttgtgtttttagtagacacagggtttcaccatgttggtcaggctggtctccaactcctgacctcaagtgatccacccacctcagactcccaaagtgctgggattacaggcgtgagccaccacgccaggtcaatatacgtgttaaattatagacatcactcagttactgttttgttcatgtatggggcaaatatatatttttatagaatatacatgtattataatttaatttctgattcaagccttaaagaaaatatgtagttcaaacttggaaataaatggattaaaagtcacttgctcttaaaatgtggtttctttttataatcttttaaaattcagcaacttaaataaaacatcctgagggcaacatgtgttagtgagggggactgggggtggcgtggggagggagtgtgtttgatgaaattgtccaggagcaaagcaccacttacttgaagcccagagatttgtcatccaaatatgtgcagattgctgggctataaatagtttgaactcaagtaaacagcctcttctccctaactgctgcttggccattgttcagatgccagcacagactgaggagcatctcacaccaagctcaaggctcttgtgcccaaattttgggctgcttctcttgtggggagagcttcagctaccctgacttgagatgaccaagggtcacatgttcaccctctttagttatcccacgtttggctcccacccctatgcaacctgatgtacagtttcataaacatgcctctgctctgatgagtagcgctgatctaagaagattcctggcaactattaaaaagccctggggccccatggctgttgactgaagtagatttaggaagcacagaagttcttttttcagggcagaggcacgcatggctcatttctttctttggaactaagtagagtggcactggttgtcagaactgctgcaggctgcctgtgccagcaactcatctgctctgtgccaggcaggcaggctgctgacatttcaagagtccctttgaggactccagcaacatgctgtcattagagcaactgaggacagtccatagtttattagtatatttcctttggaaaaaatgtctccccctctctctctctttaaaattcctgctttagctgcattgctgcattcatgtgcagtgactcttatgtcaaatgcctatgaggagattatgactaatttaacattttgttgttgagaggacataaggaatggtagaaggagtactagattaaggatcaggagcctggattcttgcgcaagttacgtaacttttcctagctttgatttcttcatttgtcaagtaaagatagtcatgtccctcctgtttcttggggttgatgagaaaatttatgtaaaggtactttctggactataccgaacaaatggaatgcaaaggagaagtagggtaatggaaggagcttggtgtttgagtctcacaggcctcgcccacactgtgacctcaagcaagtggctaatgtctctcagcctcaaccttttcatctgtaaaatgggaacatctatacttgccttgcaggagtgttagaaggattagaaataacatatgtaaagcactgacaaatggcaaacaatagttgaatagcaataattgttattattacacttaatgtggatatattcactctgggtgatttaggattctaaacctaaggaagtattcagtttatagatgtagagattagcaaaaggccctgctagtaactgatagtagcaactgataataatagctaactttaaaaaatccaagtaatacatgaatatgactttttaaaaagtctctgagtctagaaaggcatctgtctcctgcttacccctcaccctgaggcagccattttatttttctgcttttacttcttttggtggttacttctatttctctaaataatgttactcccatttccttttttaaatgaattttgtttttgtcagaaaggtacatgcacatagtttgccttagtctttttaaggtcaaatatcataaaagatttgtaataaaaaccatctgttccctgcccccaccctttctttacccttcctcctatcctgctcccaagggcatacacttttgatccttttaggcgtttgatctagcatttatctctctatatctaaataatatgcttatcgagatatggttttttttaactgtattacagaaattttgaaacatgtacaaaactagaaagaatagtataatgaatcctcatgtaccacccattacccggcttcaaaaatcaaaaacccatgaccagttttgtttcatctgtgctggtagccattttcccctgccactagattattttggagtaaattctagacatcattttatcagtaattacttcagcatgttttttttgtttttgtttttgtttttgtttttgtttttgcaatgtcgcctgtcacccaggctggagtgcagtggtacgatcttggctcactgctacctccacctccctggttcaagcagttctcctgtctcagcctcccaggcaggtgggactacaggcacacgccaccatgcccagctaatttttttatttttagtagagacagggtttcaccatattaggctggtctcgaactcctgacctcaggtgatctacctgccttggcctcccaaagtgttgagattacaggcgtgagctaccgtgcccagcctagcatgtacttttaagagaataaggactccttttaaaaatataaccacactatcacacataaaataattaataatcctttattattagcagtggtctccatttaactcataagttatttttttagttctagtcagatccaaacaaggacctcacattaccatactgctttttcttgactcatcagttttttgtttgtttttgagacagtctcgctctattgcccaggctggagtgcagtggcaccatctcagctcactgcaacctccacctcccaaggttcaagtagttctcctgcctcagcctcccaagtagctgggattacaggcatgcgccaccatgcctggctaatttttgtatttttatttttgagacggaggctggccgtcacccacgctggagtgcaatggcatgatctcggctcactgcaacttctgcatcctgggttcaaacgatgctcctgcctctgcctccggagtagctgagattacaggcacctgccaccacgcccagccaatttttgtatttttagtagagatggggttttgccatgttggccaggctggtctcaaactcctgtcatgcagctggttttgatcagacatcctgtcatgctttatttggccattcacaatcaataataaaagacttctttaaggggataggtctcagttcatctgtttgtcccataggcctctgccctgcctgggaagctgctgggtactggaagggtactaaggtactaagtggaagatgctttagggcacatgagcaggagcagcagttagactgagggcccttcacgtgttagcataaggaggccagtctcttactagaagccctcgatcaatcctaggcagttcattcaatttatttaaagaggcctcctgtctttggctgtggttctgcagagcttttgggccctctgtgtgctgcaggtatgggatagaggagctggctggcacaggaccttcagtggatcccttaattttttggcccttctgaatcttctcgacgcctgctgtcttcaggttcagagcctccctggggtcccacaccattccttgtctctcatttccaatggtgctttcttgtccttgtgctccaaacttcagcttctgttgtcatacctctctgaactttttctatcttccggaaattatttgaaatgaaatcccttgttctctaatgatccttccttcagcaaaaaggcccaatttgtagttcagaagacgtggtgctttttacaaaaagtatgttaatgttttaccatagactggactaagtagagtgtgtgtgtgtgtgtgtgtgtgtgtgtgtgtgtgtgtgtgtttagaaaatatttattgagtttcctattttatgccaggcactcttctaggcacttgggatagatgtattcagtgaaccaaggagacatactgttgactttgtggagcttacagtctggtggggaaacacatggaacgtgtacttataaatatgttaagggttataagaagagacataggagtaccatgagaccagtacagcagggggagctaacgtggctcagagaaaagggcgccctagggaagtgatatttaatctgaaatctgatggctgagtaggagttaaccaaaataagagggaagagcccttcaaatttgtatgtcaaagtgcagtagcaagtgagagtctgagaccaatagagagtagcaagtgagagcctcaaaccttctcctgttggagcaccaggctgtactacctcaggatagtcccttgccttctctggatctggcattcctcacccctaaaatgaggagaccacatgctcctttcagctgcaaaaatcaatgagtccaagactgtttaaagttaaggtcactgtttaagtgaaggtccatctctcccaaaacagctgtagttggaaacttatctcaagctggtgggaagtggtttgaaaaaaggcagggaggggacagtgtgatatcctgcgaacctatccagtttctagccacataatcactggggtcaggcttctcttctccttctggctctccttcagacacaccaaatcagcagtccaaaggggaccacaaagtggatcctcaggacatcgaaccctgaagaaaaagcagccacgtgtactccaaaaccaaaaaaatacgttgagcaatgtcttagtcatcttttgtgggtttgattccccatcccccaaaaatgacttaagtttctgatttcaaaacattgtgtgtatgtgtgtgtggttttttttttgagacagattatcattctgtcacccaggctggaatgctgtggcatgatctcatctcactgcaacctctgcctcccaggttcaagcaattctcctgcctcagcctcccgagtagctgggagcctcctgagtagctgggactacaggtgtgcaccaccacgcccagctaatttttttgtgttttttttagtagagacagggtttcaccatgttggccaggctggtctcgaactcctgacctcaagtgacctgctcgcctcagcctcccaaagtgctgggattacaagcgtcagccaccgtgcttgaccaagaacattgttttaagtgtaagtgtggttccttctctggggccttacaccaggattgtggtgagacgatgtattgttctcctttcttttttcctgttcttctgtattttcttatctttttacaataagcaattatgattataattggaagaaaacaaaatctacttttattcgtaaatctcaatcaatatacttctcaattaattgtctagaaaaagcatggaccttctaactgcatggcacagtgaataagtgagttggaaatggtatgacagctgaaacctgcctttgatgggtgatgagcgattgcactgtacagcagctgtgtggactagaaagtgggtagtggtggccagaatttctttattcatatactccttcaacagatatccgtcagttgctagctgatatagtttggatgtctaactatattggtggatagctgttggatgtcatgttgaaatgtgaaccccagtgttggaagtgggccctggtgggaggtgtgtgggttatgcgtacagatctctcatgaatggcgtgatcccctccctgctgtaatgagtgagttcttgttcggttagttcaagtgagaactggttattttttaattaaaaaaaattattttggccgggcatggtggctcatgcctgtaatcccagcactttgggaggccaaggtgggcggatcacgaggtcgggagatcgagaccatcctggttaacacggtgaaaccccatctctactaagcatacaaaaaaattagccgggcatggtggtgggcgcctgtagtcccagttactcgggaggctgaggcaggagaatggcgtgaacctgggaggcggagcttgcagtgagccgagattgcaccactgtactccagcctgagactccatctcaaaaaaaaaaaaaaaaaaaatgcaagggactacatgtgtgcaccaccatgcccagctaatttttgtatttttagtagagacggtgtttcaccatgttggccaggctgtcttgaactcctgacctcaggtgatctgcctgccttggcctcccaaagtgctgggattacaggcgtcagccactgtgcctggccctggttgtttaaaaagaacctggcacttctccctctcacacttgctctccatcttgccatgcaacattccggctctcctttccctctaccatgtctaaaagcttcctaaggcctcaccagaagcagatgctagtgccatgcttcttatacagtctgcagaactgtgagccaaataaacctcttttcatcataaattattcagcctcaggtattcctttatagcagtgcaaacggactaacactgcgtaacaaattaatcaatctgtgcctgtgattttctcatgtgtcaagcagggataataattatacctacctcatagagatccttatggggttaaatgaggtaatttatataaagcagttagaatacaaccaggcacggtggctcacacctgtaatcccaacactttgggaggccaaggcaggcagatcacttgagctcaggagttcaaaaccagcctgggcgtatggtgagacccccgtctctacaacataaataaataaaataaacagaatattacctggcatatggtaaatatacaataatagttttggggtttgtttatggatttccttattttaataagtatctcataatatgtacaaaatgctgctatattagacacagatcttttccttaaaaagttaggattctggcagagaaaaaagacctgcccccaactaaatatgtgtcatcagagaaaagggtatgtttcttaagagagaaacagagcatactaaggaaattcagaggaaggagagaccccttctaaactgggggtaaaaggtggaattaaacagccaaagtttccttcatcctcaaatggagctgatgctgctgtctgtgaaaaacagccaagtttcctgaagggaagccctttaagaggtggtagtgcaagggggttgtggattcaggactggcaccacatggtccctagttagagtgcaggctctgccccttgctcccgtgagcctttgagcaggttggtcggctcaccatgcatctgttgctacagctgtaagatgtgaatattaataatgtctcctgcacccgattattgtgaggatgacatgaagtggtgttcatagagtgctcagtgcacagcttggccccagcccacataagtgtgtccagtattgtcagttataagaagaaatgaatgtgccagtgttgctatggttctgtcttccgggattctgtcacagacgtagaattattccgttcacaagggaagtgatacagagtacatgttgttgaagaaaatgatgttgtttttatgaatgggctccttactattatttttgttcaagtaacaaaacatgattcaaagcacccatcttcaagagcccagcctcatttcctgacacctactcagtcttctggaataaaggctcagccaaacaatagccctgacctccagtccctccaaactgagtgttgctgctgagaacaggccttacagctctgggtgggcttttgttcattactcatcgtgacattctggagaaatacaggacccttttgacttcccgaccaatctctgactttctttcattgtcacatcaccattagggcaaaggatgatgaaatggtcagaattagacaagaagtattcaaatatttttcaatgtatagtatgtgccaggcacataacccacacaagaaccttggagagtaaggctgttattcttctcattttacactgggaaaccaaagcacagcaagaaggtctagggaccagaaggaagcccacatctctctgagctgtgaacggctgctctctgtgggttaccaggctggtgtttttttgttttgttttgttttttgttttttgttttttttttaaagacagagtctcactgtcgcccaagctggagtgcagtggtgcaatctcggctcactgcaacctccatctcctgggttcaagcaattcttctgtctcagcctcccaagtagctgggactacaggaacacgccaccacgcctgactaattttttttgtattttagtagagatggagtttcaccgtgttgcccaagctggtctcaaactcctgagctcaggcaatccacccacctcggcctcccaaagtgctaggattacaggtgtgagccaccgcgcccggccaggctggtgtggtttttattccacagcagtcctacgtcacattgtcacattgttgaaaagccttcagattgacaaactccctcctaatatagcctgttttcttggatgttttctgataagcatctgtgttttctgagaactaataaaaattcttgttaaaccacaaattaccacagcctcttccttacctatagagagccgctttcccagtaaagctccggtcctaccttcccatcaccatcaaagtggcattgaaacagatcagatctgctccttttgagggagttagttgaagcccagtcttgcttcaggccacacaggatttgggtagcaaagcaaggaaagcagcctctctgacctagtggcctgagtgtttcctttcccaggctggctgcggcaaccactttgagaaatggcattggcattggcatgtgtgtggcatgtgtgctgacctagttaggagttgaggcttcatttctaattctgtccctttcgttttgagctgtgtgaccttgggcatgtcacctaacttctctgtatatgtcttcttatccaggaaggagagattaataatgtagcctcatagcacttatctgattctcctaaggatgttatgagaatcaaatgagattatgtacaacgagagcaaacatttattcaatacttagtatgtaccaaatactttcagtttccttacatgtgttttttaattctcacaatcctaaaacagaggcactagtatcccacttgacagttaaaaaaactgaagttcagagaaattaagtcagacaggactcagatccacatctgtggctcccaaatgatgttcctaaccactatgcatgtcactcgctccccattgtacacgaaagtagagagatgttctttgtctttaccatcaagcactctccaaatgcaagaaatgatctctcgtaaccactgctgttccatgttggtccctaaggacacttatagcctgttacttgtttgtcttatcttgtagtttatgctgctgcttttcatgtccctaaggacttgttcagtgaattcttttggttttactcccagagaatctgttcatctccttcataaagggggttaaaggtgcccagctgagcctggcatcttgggcagtggcctctgacttctccagggttcttccttccctcaagcatgtagttgggtagcttgtagtaaaatgctctataatgcatttgtttataagttccccagtcactgatttttactcattgaatctcagaagtggaaagcaccaaagccagcattttgttgatagggaaactgaggtccagagagggatgtgacttgcttgaggtcattcattcagttgaaggcctgaccaagactggaacccagtttcccaggggacacaccagtgctgtttccaagccttccccgggggcacacatcacctcccctacatgaaggacaaactcatgtactgtgcccagcatgtacctaggagacctgggagaaatgaaacaacttggaaaattgggcaggaagaaagagatgggtgtggggtggggtgaagatctccaccctaactagtatattatataccaaagaaaggaattaaacacacaggaaagcagacaacccactaagaagcaaaggaatttacccaggaaccctggctcagtgagtggataggaagccttttgtcactaaagctgcagggttgaaaattgaaggaaggatattaggcaagcgtggtggcctgggatgcagttacagccccctggctcattgtccaaaggaaatggatctctcctgtggacagagaggtggaaactgagtgagtgagttgtgtggttgacatcatcaggctgagcattggattacaacaaatggggacttacttggcccgagacatgggaaacacccactaaaacctcaaagtgcttttcatttaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttgtaagtagaactttactctcctcccctgcccaacacccccagggagaagcagagcttggaggcagagctctctggagagcttgctttccagcctgttggccacaaaatgtctatttttatataatgatatatgtgagcttgctctgaaaattatggccttgtctgaaactgcctaaggctagtcggagcctccagtctcacaaatgggctccattcagatgctgtttcatttttactcaaagaactttgacagagtattcagagctttaaaagcagctccttgctccaaatataggtgaagaaataaatcttccctaagaaattcgtgtttgtaaaaccctttctttttttctgattacaaaggtggtataataatttttaaacattctagaaagaaaagtctccgaaagtagtgaaaattccctattatcttccccctcaggaacatggttgttgtgttaaatttcagttacagatatggtcagactccatgaatttaccacatataaacccagtgctgcagcagctgtgtggaaaactccaagatggaaaggggttggaaatctttaaccttgggtttgcgatctttttattgcttccttttaaaaatttgctgtttatgcctggaatataaacaggacatgtaagcctttaggcattttatttgttggtatctgttttcagggtttgaaactaagcaagctactctgtagagagggaaagagggggcccttgctgtacccaggtcccttacttggtgggtccctgaactgaggaggattcctaggtggcttgagatggcttgcagtgtgctaacaggggaggtgtcccctcttagcaggttaagtatatttgaaaagttacagctaacgggaagatttcagcttcaacaaaaagctaccatatattagaagggtcacccaaggaaactgtcaccttgggcaagtgtttcacactctctgggtcttgtttctttatttgtacctaatgaggggacaaaactagatgatctctgtatttccaaattcagtatgaaatgaactgtccatatttcttttccctttgtattgggcccttatggctttaggagcaaaggaccctaggttttcagtttcccagagtagctaaaaacgggtgcctgtaggacagttaaaagaagacataaaacaggcaacattaagttacttctgagtttttatgggtctttttcagattaggtgttcttgaagaaagagaaagaaaaagtctcagtggtaactgtatgtgcacacgcatacactagcacatacacttggggagagaggaaagaaggaattggcattattgagtatctcttaagcactaggccctatgttatgctcaaccctttacagagcactagatggtcagtattattccctaaccccattgactgaggacaaccatctacttatatgttttcatattatcctgaactaaactgtatttacataattactggcataacttcaattccccatgtctccactagaccatctgcaccttctctgcgtgtctgtctagcccatcactatgccccactgcctagtagaaagcctggcacataggtacaaaggagacacaacttaatttaaacttaaagcccgccatcctagttcctcatttggcaagaaagagggagaagaagggggaaaatccctctatttgcccctctttcatcatttaacatagagccaccctctcctgccacaagggaaggatagccacagccagagtgcaaaaaaaaaaaaaaaaaagcaaaagacgtcagatcttgaattttgagtttccaaggtgccgggtcttgacaaattaaggtttttgctttgttttgttttgtttttgtttgtttgttttgttttctttaagggcatcagagaccctaatcctcaggaagttgtggtatttagaaactatttgtttgaattaaggtcctagttaataagagggttctcaaaggcccttggcacttctttttttttttttttgagacggagtctcactctgtctcccaggctggagtgcaatggtgcagtcttggctcactgcagcttccacctcccgtttttgttcaagggattctcctgcctcagcccctcgaatagctgggattacaggcgcctgccaccacgcccagctaatttttgtatttttagtagagatggggtctcttggcacttctaaagctgcagtcttccccagcatttcatcccatgaaggtggactgttgctgccatggacccacccatgggcatgggcagtgggaaggccagggcatcctctgcttcatcccagccccgctgggatcttgagatttggggtaatcaaaaaaggcatcctttttcctaaggtggtggtgaggaggtgatgttctggaaggaaggtacctagactttgtggtccctgccaggaagtggagagtggaaatgtggaatgcctcacactcctcaactaggtaggccttcatgtaccagatgagggtggctttcagttcttgttttgtgtgtcaaagttgctcctgttatcagtgtgtgtttgctgatctctcccacctcagtcactcccggcagtgagtttagggcatcttgggagtggaggtaggttgtggaaaagatgtgtccagagatctcatttggctttggtatcttcctgaaataaatgtcacacacagggctgggcatcttgcatatgctgacttctcttaatcttcacagcaatgatgtgaggcagagatcatctccattttacacctaagaaaggcacagagaggtgcagtggattgcccagagtctcacagctggcaggggctagagcttgagttcccaatgagaactggttgtccccgaagcccttgaatatttcaccatactgcagtgcctttttcatatcacctccctggatctcagttgctccatctgttaaatgatgacaagtgaactctagtcagaagtcagagtggtgttttgtttttaatttgaatgcctttaggcaggtgtgttctccagttcattaccatttgcgcattcccctgtgccctctagtctcctgcctggcccctggcccctgtgggaatttgcagccctgcatctggttggtgtctaccgtttctttcgatttagacaatctagagggcagtgagaaattggaaaggggtagcaggtaagagctctcgagttcagtgagaaattggaaaggaatagcaggtaagagctctagagttcagtgacaaattggaaagagatagcaggtgagagctcttgagttcagtgagaaattggaaagggacagcaggtgagagctctcgagttcagtgagaaattggaaggggatagcaggtaagagctctgctttcaccgcctcctagctgggagatcctggactgatcacctcactttatagaacctacttctctttctgtcaagtggggggtcacagtcatactgacctcaaaggggtgccatgcggatgaaatgagatagggctcataaagcacttagttagtacaaaaatacatgcttaggattagctgctctcaatttccagaaagagaatgtcagccaatgtacacaggcatctgccccctcagacataggatggcatttgcatgaggaaccagaagttatctttgaactcatcattttgaaacccctgtgatgaaccctggagctgccatgttggctcttcaaaccaagcctcagcattatttcctgtcacccagtcaagtgatgctgaacctcaaatcagccagccagtgctgaggccaaaagcagaagtgggtgctattctcttgggaccagaggaccctagcccagccacttaaggaagaagctggtaacaggtgctggctgtgacagacaagaagctgaactggcccaattaactctgccaaatgctttcacgaggggccagaagcaattcctaagtggagactgaggtggaaaatctaaagttctgggaaacaggttattaatcatgaccctaggctgagctcactacctcctggaaatccttcagaaatgtcttaggaaaacttggagtactgctccttcaaagagtggtttctttggaagttgccgtgggctcctatgctgactgattatgaattgcagattagaacacataatgtatccgctcttactggaggaagctgcatttccaaaaagaagtctctttaatgtttcaagaaattacaggctttagcttgactcttcagaactgaataatggcccttcatggcaccgaagaaagtatttggtgtattcttactatgtcccaggaacctaggtcagttactgttttagtactttatcagtgtagtctttaacattccataaatgtacattgaggacctgttagtactaagcactgaactagaggaccagggtaaagacactgcctctggtcttgtggaattctctgtgcaacaagggaagatagacagaggagtgaataattttaatggcacgtgaaaagtactgcaaaagaaatatgcacaagtgctacaaaacaccagacactggatcagcatattgtggaggtcctgatcttgcgctgggttgattccttctgctctctccctacaattcctggctctgggagctttgccagcatttgcattagggagcaactgagagctgcccctgctgaagcactcatttctggcaccttcctatcccccgtggcttcagaggggtggaaagaacacttccttacaaaatgtatgggccccacctgagagggccctgaatctgaagtccaaagttgtagtaaggaaacagagggacgggtgacttttgtagtctaaaatcaccactgattttccgttggtttgtttttataacatttattgtggattttttttttctgattgcaaaattagaatatgttcaagggaagaaaagctagatagtacagaaaaacacacttaaaataaatcatcactcagtgatttcacttctctgtttttgaataagggcctgtctcccaatccccccacccacataccgctgtatttcaagtttagctctaattttaatttctccctgggcaaagtctcatgtttgtttgcatatctcaaaggtgcttgtgttgtgggctccaatcactactatctgcaattggttagagcctgcggccatcatttatactttcctggacgtgtgtgtagattcatctactgctaagaaccctttatgtgttaggcattatgcaaggtgcggtggggaatgtcgaggtaaataagactttgaggttgctcatggccggataggaaaaaaagactcagataacatgaacacattgtgaaaatgtgccccaagatggggacagagtcctgtagaaagcctaagagattggaggagcagtagcatttgagctgagccttcaataaatttttcatgtatttagccaatatttgttgagaacctaatatccgccaggcactgggcaaggtgataggtggatgatgttaaatataacaggcatggcctttacctgcatgaagtttacaagcacaaatggtggcgttaagaagtcaataagcagggggagtgaaagaggagagtgtggctggggtcttccttgaaaaggtggtattcaaactgagaagagggctgggcgcggtggctcatgcctgtaatcccaacactttgggaggccaaggcgagtggatcacctgaggtcagtatttcaagatcagcctggccaacatggtgaaaccccgtctgtactaaaaaaatacaaaaattagccgggcgcggtggcacgcacctgcagtcccagctacttgggaggctgaggcggaagaattgcttaaacttgggaggcagaggttgcagtgagctgagattgtgccattgcactccagcctgggtgacagagtgagactttcaaaaaaaaaaaaagaaatggagtcacttataccaagagtaaaggagggagagggagtaaagaagggtgctggattattccttcctttgctcattattgattctaaaaatctcacttattttctgtattcagtttcctttctattggagaatattcttggggtctgtgaatggtaaacttgcccagtctttgtttgaaaatatcttttgccctcacacttgatatgttagctagatatagaattttttgcatagcatgtgtaatgaatgtgaaagttatacatgcctctttaaaagttttcaatcaaaacagaaatagataatgtacaaagtgaaagtctttcatttcttttctcacaatttctcaaaagagaataatttttttcaaaagagagaagtttcccagggggaaccattggttacagtttgcccttttctatatatactgaaaattgtttaaagtgtaaagtatgtatactttttaaaaatgtgcacgtacacaaatgctgtactttttttttttctaaacataaataatcatgttcacatttgagcaggacacagtagttcacacctgtaatctcaactagtcaggtggctgagagtggatgattgcttgaggccaggagtttgaggctacattgagctatgattgcaccagtacactccagcctggggacagagtgagacctggtctcttaaaattaaaaagaaaatgtaaagttctttttttaattaaaaaatgataatatatgcaattttacaatatgctttttaacaatcaagcatgtacttttttccacatcagtacaatgaaatctccttcattctttgaagttgctgtatagtttctcatgatattgatacaccataatttaactatttttctattaatagacatttaagttgttttcgccccttggttttgctactatacagtatttcactgagtatctttttacttaggtaaatatatctgtagtataaattcctggacatttcaggaatgtgacgtgtctaggaatttgaccccaaaggatatgtatgcacatttaacaagttaatagatattgtcaacttgtcttcccaaaagattgtttcaatttataatcccagagtatgtctggctctaatttttgtttttcttctggttccttagaattcccgtactgattagtcaacagtggaaaatctgaagagatgcaagcaggaaaaagaaattaaaccaggtaggtagtggcactgttcatactctactgccagagcagcacacgtttttgcctgaatatctttatttctggttgaaggaagaaaatacgtaagttccaaactaaattagtgggagattttgaccttatgaagaaaaggcaggatggctcttttcagaagttatatacataacagcatgctacaatttcacagtcaagattctgttttcaggcgttttttttttaatagcatcagaaagaaaatttacctttggtggcttaagaggggatgggtttcccggccatgtacttaagcttaagcaggtggaatcatacacaggagttattagcaacattgggcctggtgccagctttcctctccaccaagtgtttgctgtaaagctgttttcacaaagaccagggcacattatgggaattttcattttaatgctgtaatagaggagcaaaagccagcaaaacccaacccaaagaaatgggttcggcccagtagtctggtgagaagggatgaagatgcagtccctccagctgagaacaaattgccattcaaagagcacaagtggcccacctggcagtatggccaccttgggtccagtgtccatagtttatgatatctaaatgtttctggcataagttaataattttaaactcagggtaacataataatcgactttttacctaaagcagcagtatttatcaacaaatctggtgaatttctttgaattgtcaagttggaagtactgggtccacagagatcttttcacccaccaggcatccatcagcatccatggatgtggttgttaaggtatcagaattgaaggctattctagattggcctacacccacctggaccttctccatagctggaattttcacaaagaggctaaagagcctggggatgagcgcatcgctctgaagagcttgccgaatccactgtgcatctgtccataagctaaggatggtgtgaggactgaaagctgcatgggagagagaaggtcttgtgattttctctctcttcagcactgtagggggcacattgcagctgtgtctggtgcagctcagtttagactcctgcctcagccaggaaaagtttttttcatttttacattaatttagcaggtatttatggagcatcttctataaattggacaccagataacaaagcaaaagtggcacagtccttgccctcaggaagcttgtgggtctggctgacagtagactagtagcagtagtctgcggtaggtccagagggctagtgggcagagggtgctgcggcttgaaaggtatgcaggagatgacttggagaagagtgggcggggacaggctgggggcttgcggagcagcacagcgaaggcctggaggcttggggggtgcagcactccatggaaattccatgggccaaacacagtgcagagggggttccctggctggagttgagtctggaggtgtccatgaatgaatctgaactttatcctgatggctctgaatggaaagtcgctggagggctttaagcaggggagagttgtgagtcaggcttaggaaggagactgtctagcttcagtttgggtaagggactgagagagttctaagggactgagagagttccgcactctgcctggcccactctcatcacctctcttcttagcgcctgtgctcctccttcccttggaacttcaagaaggcaaaggacagagcccgaagtctgagataagatagactccttggggagaaaagaggaagtggtgctgggtgggtgggtgggggcacccagtgtaaagcagagtgtacaggttgccttggacaagtcacttcacacctatgagcttcagcttccttatctattaaatgaagataataagtattactcttcttttctctcatctcatgagatatcatcatgatatcttaaaatatcatggatattttacatgcccagctagggcttccagagaaatctctctgtttcgtttgccatgtaaggatttgttgaaatcctcaagcgcacattaagtgcatcctgtcgctgcagcttatcgcctgggatgagagcagtgaagaagccctagcctcaggatcagtctcacagctccctctccctgcagccaagaaggaccggtctacagaggggagggagcaaacactgaccgaaggccaggtgtgtgcttggcaccacccacagacaaaagagtgcttgggcagagctgctagaactattatttaagccatgtgccagatgtgataagcacttacatccttctcagcctcatttagtttgatcttatgaagtacatatatattatctccatttgatagatgaggaaaccgagactcaaagaggtggaactgcttgctggtagtgacacaattgggaagaaggagaagggccggagtctggagttcgtgctctctgacttctgtgggtagcatctgccattctgctggtgctccttcagacctttcagacagtgcagaggacacagaggaatcaagggacagctgttctcttacaaaccttgaaaatcctgtacagagccctcagataaccaaaacgtggtccagaactgaatcctggggccaacatgcccatttagcacttctctcaatcagtccttttccccaggtgcattaaacagggcagctgccttcccaccctatgggcaaactgcttggcagctaggagtgtgcctgctcatctcccaggctgctttcctttgcacctcagcaaggagggcaggccgtgcatccagggaagcacatagttactccttctgccagaaggccaccccctaatctggtttaccgtggacactgaagtcactccctgtctcctggccatgaggaaaactcctttgagaggagcctctgaagccagtggagagagtaaaaagtgagaatcctgcctagttgaacaggcagttcagcctgttctggaaagagttaaggctgtgtccataccaagccatttaaagaatctgcccagtagaatcaatattgtcaaaatgtccatactacccaaagcgatctacagaattaattccattcctatcaaaattccagtggcattgcttacagaaatagaacaaataatcctaaaattcctatgaaaccatgaaagaccccaaattactaaggcaatcttgagcaagaagatctaagttggaggcatcacacaacctgatttcaaatattataggctggacatggtgactcacacctgtaattccagcactttgggaggctgaggcgggagttcgagaccaacctgggcaacatagcgaaaccctgtttctataaaagaaaaaaaaaaaatccaaaaagtagctgggcatggtggcgtgcacctgtagtcccagctactcaggaggccaaggtgggaggatcacttgagcccaggcatcgcatcaaggctgcagtgagccgtagtcatgccactgtactccagcctggctgaaagagtgagattatgtctcaaaaaaaaaaattataatgctataataatcaacacacacacacacacacacacacacacacacacacacacacacacacgactattactcagccttaaaaaagaaaatcctgacatttgcaaaaacatggttgaacctggaggacattgtgctaagtgaaatagggcagacacagaaagacaaatactacaggatctcagttatatgtggaatctaaaagagttgaactaagagagagtagaagggtggtttccagagagagtagaagggttgttggggaaatggagagatgttgagcaaaggttacaaacttgcagttataagatgaataaattttggcgacctaatgtacagcatggtaattacagttaataatatggtattgtatacttgaaatttgctaagagagtagatcttaagtattctcgtcacaaaaagtaactgtgtgaggtggtggatatgttaattagcttgattgtgataatcatgtcacagtgtgaatatataacatttttatttgtcattcataccttaataaaactgaaaaaaatttaaagaatctgcccaggtcacaggaagccatcagtcataccctgagctgttgtgtaagctcaaagagtatggtttatagcatatggatgagtgctcttgtgccaacgctgggctaaacctttacatccagtgtctaattaggtagtttctgttattatccatgttttaccaaggaggaaactgaggcttttggagattacatcatttggccaatgtaccagagctggaaagttgcataactaagatttcacttgagctttttttagctccacatcttctattttttcagctacaccaaaacgacttctttaatttagctttgcttttctgataatagtaaccaccaccctttattgagcatcttgtcatgtgagccaggcattatacatccattatttccaatcccagtagaaccttacaagtaaagtatcattgtccccgtttcacagatgaagaacctgaggttcagagaggtcaggaattttgcctcacagatttcatctgagactagagtgagctctcaactatcatcctgtacttccttcattccttaccttttcaggttcctaggaggaaaggactcaaaaaaattatgcatgaatttcctttaatttcacaacaaccctaagggttgggggttgatatctctgttttacaaaagaagaaactgaggctcagagatgttaagtgatttgctcagcgtcatgcagctagcaattggtggagccccgattcatacaggctctgacccatagcttaagcttacttgcctcccccattcccacccctcacccctcttcggctctgtctccttgcaatgggggcagaaaatccagcctttatttctccaggtcctagtagtcctgggagtctgggggatttccagctcctttgaattcccttttttggcctctactctgcctccagcacctctcttaagagtccttttcactgttgtcatagcaagggtctcatctggagggaagctgccttgaggttggaactatttggctgcttatcagcaaggcttcagggccttgccatagcaactttccaagccacccatcttgtgacctgttctgactcagggcccctgggaatcccctgggtgcagatgtttgcagtgactaggatgcagcagtcggctcccaggactctttttctggccaaggccattttaggaaggcttctgttccagctgtgctgggagagttgaggtccagagcctccaaaccttaagaatgcagggttatgtgatgtctagagctggagtttttagccaggggcttatgggttaagagccccctgtgatcataggtatggttacacacacacgcagagaatatatacttttctgggcaaagtatctgtagcttccctcaaactctcaaatgtgtctgtgacccttaaagtttaagaacactggtctagagagaacccaaagtgttgtgggccactgtgctcccttggccaccagcctctcagatgccagaatcttgagagagcacaccaggcctctagtgtttctgcttaggcatgaactgggatacagtatcaaatattgctgaagttcacaattataactataaatgtacagctgtcctttgggatgccccaagtacttttatttatttatttatttttttgagatggagtttcgctgtgttgcccaggcaggggtgcagtggcatgatcttggctcactgcaacctccgcctcctgggttcaagcaattcttctgtctcagcctcctgagtagctgggatcacaggcgtgcaccaccatgcccggctaatttttgtatttttagtagagatggggttttaccatgttggtaaagctggtctcgaactcctgacctcgtgatccgccagccttggcctcccaaagtgctgggattacaggtgtgaaccactgcgcctggtgcccctggtgctgtaaaagtacaactgtcctgtggatgccccaagtacaaccacgaaaatgcatgcccagcaccccaaacatgtcaacatgtttgaacatagtatattcaccccataagtggtagccaattttttattttattaaatattaaataaattaattttaaacacatttttgttttgttttactcttatcattgttattatttatttggtcaggagccaggaatcagatggttatttagtcactgagtgattaaaatctatatgtcaggagctgtgctatatttcaaagatacagtgacaaacaagaaaggcagggtacctaccctcttggaatcagttggaatggcagataatgaacaaatgtatcagcatcatgcctggctcacgggacatttctgtgtgtatttgtcgaatgactgttgaatgaatttcgactgagtcattattaggaagaagtcaaggtgctgcaggtggcaggcaaggaaacttcatctcttctggtgggtcagggaagaggaagagggactcaggctaaagggcctacgccccaggctgccaggaattacacaggactgtttacagggggctggcattcccatgaagactggaggtgtggggggagggctggaatactgaacaaccaagggcttaggaaccttgagtaaatgatgttaatgtgggccagaggtacggatgacatctacactctgctcaagtagtgatggtccctggcttgcaaacatgttgctcttccaggttccaagggaggctgttgttcaaccggtatttacctatgtagcaagttctgggttcggaaccctacttctctcaggaggcaggaaggatggaaggacatccctcctgcagctgaagacggcagagccccagccactgctggcagtggccgtggacacacagtgcagtgtctgagcagtgtgtgaagagactcccttactgtctgaagggcttcactcaccctacactagtgagaagcctctgaatattgtcttggaagggaagcattcacatattaagggtaaaatcaaagtcagagcaaaatttaaagtctgctctttgcccctcaagaccctgaaagtccccagtgactgtcattccactcacctcctctcccattcactgctccccagccccatggcctcttattagtctttctgggcagcaggctccccttgcctcttgcatgctgtgccctctgcctcgcatacttagatgtatatgcagaagtggtttctaaactcctctctctcatcatgtgtgtgggctgtgatacccaaccatcagtaacagcagctgatgaggacagtgatcattagctagagagcacaccctcagtcgctccacccagcattattagaataataataattccccaccaggtccccccacccggcattattagaataataataatcccccaccagatccccccacctggctttattagaattactatgagaaactatcctctagtgattctgttaattgtgatttttgcccccctactaccactggttaagaattacgggcttatgaactgagctccctaactagaccatggacttccctcaggggcacaatggtatcttactgtttttgtatctgtggtatctagtcccaagcctagtatacactgagggatcagtgaaatttttctgaaggaatggatgaatactatagagataatatcttgcttcttttcattctccacggtgtattttggagatgcattttatagaattagaggaactagaattgacacaaactgtcttcaacccatgaaagtctgtgcttccatgaaggtctctggaaagcagcagaacagtccatctggatcactgcttggtggctgggcatgctgggtcctccccgggcctcctgctgcggatgtatgatctaaatttgccgaggctcagctacacagcaaggttctcagagagtggcagtctccatcctactgtgaaaggaggggcagttttccaaggacttccttgctttcctgcccttccttcagagctagaagactcttacctcccttaccccagagctagaagtaacattagagattgcttcagttatccacttctgcataatccatcacccctgttactcagtggtttaaaacaacagcaatagtttcttatatctcatggtttctgtgggtcaggaatttgggaacagcttggctgggcagttctggcttggatcttttatgcagttgcagttagatggtggctggaactggagcagcttggggccagcaccgctgaaggctggccggctgctgctctttcctggccgtctcaggacctctcccctgtggttacttcatagggcctgtttgggcttcctcacagcacggccacctcagatttcccatatgcagctcaatgctctagaggcaggtttccccagagagagctaggtgaaagctgtataaccctttatagcctcatcttggaggtgacacaaaatcatttttgttgcattctatttgttagaggtcattaaggccagctcgttcggggaaattgaaattaaactctacctcccgagaggaggaatgtcagataatttgcagacatgtttcagaaccaccacagagatacccagtttcccccttcattccacacttgagactcccgaggtttgaggggaagagccttgtccagaggtgcccagcctggcatgggcagacctggagtgtgacccagcccctaggcctttggcaggcctgccaggaagtgatctcactttcccttccttcctgtcccctcacagtaagatagagactgccactctctgggaaccttgctgtgtagctgagcctcagcaagtttgataatacagacacagcaggaggcctggggaggacccagcatgcccggccaccaagcagtgatgcagctggactgttccgcagctttccagagacctccatggaagcacagacttccatgggttgaagagagtttgtgtcacaattccagtccctagccctggccctgtgtgaagtagtaacaccgccctgccagtaggatatagctgctgaggaggtaagagttttaaaaaattcataccccaaaataattatttttactcttgctgtgaagttagataccaaagagtagaatgtggtggtagaatcaagagagtcaacccaacatcactgaaaagattctgaaggtttgtatccagctgaatatccaaaacaggatgttgcttaagcatgggtaaaatgcatctggtgtatgttttagacagccttgtactatgttttccagggacttgcttactttcttgcccttccttaagaaatgccttattatgaagctgggggcaggggaaaaagaaggtcagaaaagggaatgggtacttttcagtaaatccatactacatgccaggcataatactaattcactcccctgctttatagcctaatagcacaggctccatctggctccaagctccctaaccttgctgagtttcagctgcctcttttgtactatgggataatgatactttctgtcatagagttgctataaaattaaatgcttgtaagatgcttagcacagtctggcatgcagtaagaaagaactgtgtaacaggccaggcaccgtggctcaagcctgcagtcccagcactttaggaggctgaggcgggcggatcacaaggtcaagagatcgagaccatcctggccaacatggtgaaaccctgtctctactaaaagtacaaaaattagctgggcatggtggcgcacacctatagtcccagctacttgggaggctgaggcaggagaatcgcttgaacctgggaggcagaggttgcagtgagccaagatcgcgccgctgcactccagcctagtcacagagcgagattctgtctcaaaaaaacaaaaaacaaaaaacaaaaaaactgtataactgttggctccaattaatccccacagccactttttaagacaagtgtgagccctcccattttatagaaggggtgtctgcagttaggtgaggtgcccagcatcatgtgccactgtagggacagcagctgagactctgaagtccttgtggcatccaccacaccacattaccctccgggcagctctgccagggctttcctgacatgcaatagttgggggcagaggaactcaggaggctttgtgccctacaggagccccatgtcaggtcctagagcaagaacatttgaaaaaccaaggccaggaatccatttatccacttaggaggctctatagggagcagggttacagagaatgttgtacacagaggaaatagtctagtaaaggctttgaggtcaggaattaaatgaggtttgaggatttaaagagaggcccagtgtgaccagagcaaaatggaccaagaagagagtagaaatgagacaaaggctcatctgcagaggcaggcagggccaggtcaatgcagggcttcagggactggcatcaggagagtggatttcactagatgtgaaatagaaaagcatcagaagttgaacgaagcagggaaattccagtgatccaatttccattttgagaacgttaccctgcctgccatataaaaaatagaccctgggctaggggtgagagagacacaggactctggtcagggtctctgctcagagtcctggtgagacattccggagcctgggtggtgcatgtggaggagagaggtcagcagattcaagctctgttttgcaggtagaaacaaaaggaccaggctgggcactgttgctcatgcctgtaatcccagctctttgggaggccaaggtgggaggattgcttgaggccaggaatttaagactaggctgggcagcatcgtaagaccctgtctctacaaaaacattaaaaaaaaaaagaagaagaaatgacaggactgggtaaagaattgtccatgggtggtgaagaagaagcgaggtcagggatggtcctgggtttccagctgggcagatggtggtgcccttgctcagttgggaaggccgtggcgagcaggctggtgacttgacgtctgaagcttgcagtgctgtgggatagccaaatgacacgctcaataggctgagtcagaaatctagaactcttaagagagggttgcagctctttgaaggtcaccaacatagattatttcgggaaaggataagagcccctcgggagcaaacagaagagactggcgtcctaacacaaaggtcccggcagtagcaggtgcctgtgcagactggttggagggaggcccaaagggtgtggtgtctggaagtcccatgaagagaatggtccgggaagaaatgagttggaagaggaggacagaaaggtgtccctggggataggcaccgtagaagtcactcaggaccttgtctgacttgagcaccctgaccttcccttcctatcactgcctgcatccaggcctgcttgggtctaggcctggcaggtgcagaggccaaggcccggcctctctgcctccaaacaaagcctcacccagggccactctttgaatggcaacaggcactgcccaggcaggcgacaggctcctctctggtgaccttgtgctggatgtgccccaaggcgctgggtagggctttgcagccagccccaggcaggccacacatggatagaaccggcagccctcccttttcccaggttcttggaatattctcattttggggctctgagttttctgttggcctcagtgcctctcttttctggctttctatcacagagagaagccgctacccttgaaatttgatgaatgcctgttcagtaggccctggcatttctgtttccacggccctttcgtccctcagagaagccttagagagcattttgcccacccctgataaaacttctcccataagaccaggtcccacttctgtgcttcatgtcttctgcaaaagtctgtttgctttttgtatggtttctgcaaatactgaatttttgaaaaagaaaaaaaaacaggaaatgacctttctagtatatttggaaaacaatttggagcttgtaatggaatctgcctgagcaatgaggactaatagctgcagacttggaacagaccatgtagctcttggcagagcctggggcctcttcagtttacaaagctggggggagtattagaaacccacgggagaagtggcttcctgtggggaaatgcccagagcaggcacctgcaggcactgtaacctctgaccccagggccccaaaaggcctggggacagagtataagggcttcaccctttgtcctgggcattcaaggtcaatcacatgtctggcaatcatccagatcccacaagataccaaaacctcctgaggatgaggaaaagaaagagcttcattctttagcaccctgtagggctcaggctgagctagaagattctagattgtttttagactcaaattgcctgttggctctctgggtccctctctatccaacttttctgtagatttcagcaaaaaccacctcctcagagaggcctttcctgatcatacagccattaactgcatgatccacatgcagagaaccctctcctcttctcccatagcacataccataatctgtgataagattcatttacttgtgcagtgcctttttctctttacacattgtaaatatcttttttagtttccagtatataccctatgcccggcacagtgcctggcatgtagaagttgctcagtacattgaatgaataaatgaaatatcaagactggaagacttggaggccaggtgcggtggctcatgcctgtaatcccagcactttgggaggccgaggcaggtggatcacttgaggtcaggagttcaagattaacctggccaacatggtgaaaccccatctctattaaaaatacaaaaaaaaaaaaattagccgggtatgttggttcatgcctgtaatcccagctacttgggaggctgaggcaggaaaagcacttgaaccggggaggtggaggttgcagtgagcagagatcatgccactgcactccaacctgggcgacagagtaagactccatctcaaaaaaaaaaaaaaaagactggaagacttggagatcatatttcaaacttcattatttagatggtgggaaaggaagctgagagagaaggggactcatcaagggtcaccctattgcgcgggtattgaaccagatcttcagccactgttatgatgcagggccgcacattctttgctcttctttccctgtaatctagaacatcttctattattcacttgttcatcagctattcattgagcttcaagtatgtgcagggccttctggacgtaacagtaaacacaccagccagggtcaccacttctggggaatttatattcttaccacacaacaccataaagcaccaaagaaggaagttttaatcttctgtagcaccgttaaacagagtaaaaacaaaggagctgaatgaaatgtccaaaggcaggttttactaactcagcccccaaatgaaccatcctaatcatttattaattgcattccacttacattccccatcacttactacactttttgcatcaccatcttattgaatcttcataacagccccctgaactgcagggtgtgactgttagccccgctttgctgaggtgaggggagttgtgcacggcccacagctggtaaacaacaaagctgggctggacgagcaccctagatgccttctaccctgccacccattcccctcagagatttgtaatgtcatcagggactcccaagggggcagtgtgatgtggggaaaagagctctggaccgggagttaggaccgctagatcaagaaccctgggcaagtgccttgccctttctgagcctccgtttccgcagctgttgatgagaggcttgtctagatgagctctgggatgtctttcggttagattctacaacaacttttcattaattgaacaggtatttgccctgtgatggtcctgaatgaatcaaagctgtctccctgctggagataggtcatgggctgttggaagtaaaggtttagaactcaggagagaaaagactgtagacccatgtgttagggcatattagtaatcatatattgagaacatccttccgtgtcaatatacataaatggattggcctgattctttttaatcattgaaggtttctgaactgagcatgaggatgagccaactgatgttggggaatgtccctcttgaagtagaggacagagggcttgaggatgaattgggggtgggggtggtgaggaataagtgagaagactgggggcagaaaagccagttggggaaggttgtagtagactggatagagatgatgaagcgtaactgaggccatgattactgcatggagaaaatgggaagatggacctgaagagagaaaataattgaacctgggtaattgagctttaaggtgcaggatgccttcttaaagagaggaagaagtcaggcatgagttacgggtaataggtttttgacttgcataattgattgtggaggtggctcctgactaagggaatgaatgagagagagtcctggaggagggagagcataattttgttgatatcctccgggaggattcatctagatgtctgcagctcagcaatgaggggatcgacattgaaatgaatggaagatgatgtcatgagagagaacgagacgtgtagaacaattagagaaacattagaagagagtaaaggatggaattaaggagatatacaagtagtcaaggtgttggactaggagaatgtaaaagagcattctgagaagttgaaggcagttgctttactgcctgagccttagtttcctcatttctaaaatgaggattagaatcgtgcctactcgttgtgtttagggttacatgagagaatgtgtggaaggcacttaccttgcatatcagaagtagaactcatgcaataattcatcattcattccgtaagtaagagtcaagcaccagcatatgccaggcagctgggccagccctttggagtacacagaggagcaaaagggaagtctgagtgcctgaccttgtgggagaggaattgtgaaagaaagaagactcaatatcataaaaatgtgatttctatctacattcaggtaccagatattactatatatatttaatgcagtcctgataaatacaagataaattgggggacaagttaaatgactattaagtttataagaaaacatagatcagcaaaaacagccagaaaaaaaaaatctaaagtcaaaaaagatttgagctatgagaaggaaaccatcctacaacatgatactagtatatgagtagacagatcagctggagagattaaaagattcagaaacaggccaggtgcggtggctcacgcctgtaatcccagcactttgggaggccgagacgggcggatcacgaggccaggagatcgagaccatcctggctgacacggtgaaaccccgtctctactgaacaaaatacaaaaaattagccgggtgtggtagcaggcgcctgagtcccagctactcaggaggctgaggcaggagaatggcgtgaacccaggaggcggagcttgcagtgagtccagattgcaccactgcactccagcctgggcgacagagtgagactccgtctcaaaaaaaaaaaaaaaaaaaaaaagattcagaaacagaccccaatacacagttttgtatgtaacaatgatagctttttacatcaatgaggaaatgatggattactccacaaatgatttgagataggtagaaaaaattaaggtggctcgctaattcataccttattacagataaattctagatcaaagatttaaatgtgaaaagggaagccataaaagtactagagaggccaggcgtggtggctcacacctgtaatcccagcagtttgggaggctcaggcaggagtatcacttgagcccaggagttcaaaaccagcctgggcaacatagtgagaccccatctcttaaaaaaaaaagaattagctgggcacattagcatgcacctgtagtcccagcttctcaggaagctaagctaggaggatctcttgagcccaggagttcaaggttgctgtgagctaggctggcaccgctacactccagcctgggtgactccagaccctgtctcaaaaaacaaagtaccagaaataaacaaagggatttctttactaatcttagagtggggaagacatttctaattatgttacaaagcccagaaaccataaaataaaataaagatcaattttactaatgaatataaaaatatgtatgtggggagaagtgccgaaaaataaagtcaaagtacaaatgacaagtaaaaaatactagtaactcctaattagacaaaagactaattgccttaatatattaagaactcctacaaatcaataagaaaaagacctaaaatccattagaagtgggcaaaagaatttgaagaaacagtaaacagaaaaggagatgcaagtgggaagatgctcaggttcactcctaggagcagtaggaactaaaacaatcaggcactggttttaaaaccaccttttagattaggaacaaaacagcattaagaagactgtggtgaaggaaagtgctcatctgatatacctactggggattgctatggtttgaatgtgttccctccaaaataccaatgtgataatattaagaggtagggcctttaagaggtgattaggtcatgagggctccttccttgtgaatgggattaggcaccttttataaaagggcttgaggccaggcatggtggctcacgcttgtaatctcagcactttgggaggctgaggtggctggatcacccgaggtcaggagttcaagaccagcctggccaacatggtgaaacctcatctctcccaaaaatataaaaattagctgggcgtggtggtgcacacctgtaagcccagctacttgggaggctgaggcaggaaaatcacttgaatctgggaggaggaggttgcagtgagccgagaccatgccactgcattccagcatgggcgacagaacaagactccatcaaataaataaataaatgggcttgagggagtgagtttgcccctttttgcctttctgccatttgctctgtgagaacacagtgttcaaggtgccctcttggaagcagagagcaggcctcaccacaggctggcgccttgatcttggacttcccagcctccagaactgtgtgaaataaatttctgttctttagaaattactgagactcagatattttgttgtagcagcacaaaacggactgagagacaggaactaacttctgtggggagaagttggcaatacctgttataataaaaaagtcacagatcctttgaggtggcaattccacttttatagaaacaatcctcaggtccatcaacagggaagtaattaaatcaatctacaacagtgagacaacagagtatcatgcagacaataaaaggaacaatttagttattactttgggtttgttttcagtgtgttgatgtaatcagtgctgcagtggcttcagagtgatctacagttgtttccaaggtgtgtgtgtgtgtgtgtttgtgtgtgtatatgtgtgtgtgtgtgtatatatatatatatatatttttttttttttttttttgaaatagagtctcactgtcacccaggctggagtgcagtggcgcaatcccggctcactgcagcctctgcctctcgggttcgagcaattctcctgcctcagcctcctgagtagctgggactacaggcgtgcaccaccacacccagctaatttttgtatttttagtagagatggggtttcaccatgttggccaggctagtcttgaactcctgacctcaggtgatccacccgcctcagcctcccaaagccaagacacatttttaaatgaaaaaaaggcaagatggaaaataaatttttttttttttttttgagacggagtctcactctgtcacccaggctggagtgcagtggcacgatctcggctcactgcaagctccacctcctgggttcacgccattctcctgcctcagcctcccgagtagctgggactacaggcgcccactaccacgcccagctaattttttgcatttttagtagagacggggtttcgccatgttggccaggatggtctcgatctcttgacctcgtgatccacacccaccccccgccgcctcggcctcccaaagttctgggattacaggcatgagccaccatgcccggccaaaattttgttttaaataaaggaaaaaggaagggaaggagaaaaagggggaacatatatattgcataaattttgtctggaaggacaccaaaacgtgcttgccttggggagggtgtctggatcggatgggaagggagactaagctcttatctctgtccttttggaccttttgagttttagaccacatgcacacataatctaaaattaagtaattttaagatgaagtgaatgtgttcactataaaaaggaaatataacagattttaaaattacttataaaaatattaatgtatgtaattatatcactggtattctttttcatttaactatatgtgaacattttgccatttctttaaaaaatattcacaaacatcattttaatgcctgaatggtatttcatttagatacaaattagttaagtatgtatatattaataattctccattgtccgtttaggacatgtgacacatccatttaggaactcattttggtgtctttagtttcctgctattataaataatactgtgggccaggcgcagtggcttaggcctgtaatcccaacactttggaagtccgaggcaggaggatcacttgagcccaggagtttgagaccacgagtttgagaccaccttggttaacataatgagattcccatccctgaaaaaaaatgagccagacatggaatagtcccagctactcaggaggctgaggcaacaggattgcttgagcccaggaagttgaggctacagtgagccatgattgtaccactgcactccagcctgtgtgacacagcgagaccctgtctcaaaaaaaaaaaaaaaaatactatgaggaacatctttgtacattttatcttcatgtagatcttggattattttcttagaatagattattataaactgatttagtagctaaaagatatggaaaaagttgaggtttctggatacacactgtcaagtcactgcccaaggaggtcttggaagtttacagtctcattaacagggtttgagaatgaccattttctgacaggatttccaactctgaggattctttatttccccatttgctgttgactctaaagatgagagggtgagtgacgaatataaatatgggagaaaaataaaacgatgtgtttctgctttcgattggagagctccccagagccgtctttggaattgctgttccctgaggggatatggtagccagagcatgttggcccagctgatgttttctaggattggtctttgagtgtggcatttgctgtctctgtgtcccgagggccagtggcctgcactgggcagcctgtaacatcagatggcattgtgagatcaaagccccaggagacattccagcatgaagctggcctttcagatagagcctgtaattccatcccatggtgtcaggtcctaggacaagaacacctgcacagcactccacggtgcacggaggcccttctcaacagccccaagaaggaactgcggctcctccccacagaggacaggcgggcagcaggggagaagagggatagacacaaactccctctccttcagaggcccgagagtgaaatccagcgagtgtgcatggagcgcctgctctttaccaggtgctggatgagaatcagggaatgcagcggccagaacctgttggctcagctgccaggattaggtttcagctggacatgggaaaaatccagaccaaattcctgttcccgtggagctgacagtctaactgaggaagagccgaggactcggaggctccgggagccagtgtggcctgctcggggtttgtcattttccagagcagcgggtttcaggtggggctgaggcccttctgagccgtggctgtaaaccggcctcactcacctcagagggcagctgtggccactgagtgcgtgatgtgtatgaaaacacaggcacctgggccatggtacctttccttatcgtaggaattgtcagcatcatttttatcctctgttattactgttattatcataagccattttcctgtcctgaagcattgagcggtttccccagaggcagagcgcaggagtgaacctccgtgacctgtagaaggagccacctctggaacttccgggaattcttttagccaaggaggagccagagcgtgactagggcagcgcgcaaggctgctaggaagataggcagggtgcgccatctgctgtagccggggggaattgccgtggacagtgtcctggccctcctctattttacacaggggaaatgaaggccccaagaaaggcagggtcttgcccagggttaggtggcagagcttgggtttaaggtcacgtgtctcattctttgctctttctaccataggacacctccctgtctcacctgtctgatctttgagggcccctaattcattctttaggtgtttcttctgagctaggtgttgtggggggatgtgggccttgccctccatactgatcctcttctctgtctctctctttctctctctctctctctctctcttctctctctctctctcacacacacacacacacacacacacacacctgcagcacttactggctcaaccccaccctgggtgccttctgggcacttctgccaatgtcagctaccttctaaaagcattgcacaataatttgggtttataaaacttcaaccattgaaaaaatatagacttagaaaacgaaagttccccttaatcacaaagaaccacagttgacagggttgatagatgttttttcagatttttttttcatatgtctgctatctttccccacaggaactgggttttattttaggtgttgttttgcaacctctgtttttcagttgccagtttatctcagacattgtcctatgtcagtacaggcccatctggcacatttctttattattttttttttactgacatgtcattgtatatatttgtggggtgcaacttgatgttttgatacatatatgttgtataataatcagatcagggcagttagcatatccatcatctcatgcatttatttctttgtgatgagaatattcaaaagcttctgtagttattttgtaatatagaatgccttttttttttttttttttgagacggagtctcgctctgtcttgcccagggtggagtgcagtggcgtgatctcagctcacggcagtctccgcctcatgggttcaagagattctcctgtctcagcctccagagtaactgagactacaggcgtgtgctaccacacccgactaattttgtatttttagtagaggcgacgtttcacgatgttggccagcccagtctcgaacttctgacctcaggtgaactacccgcctcggcctcccaaagtgctgggattataggcatgagccaccgcacccggcctagaatgccttattgttaaccatcaccatactgtacaatagaacaggaacttactgctcctatctaattgtaactatgtacccgttgaccagctttccatcctttcctctcctctcccctccccagtctctggtaaccactgttgtattctctccttctatatcaacttttttttttttttttgacagagttttgctctgtcacctaggctagagtgcagtgtcatgatcttggctcactgcaagctccgcctcctgggttcacgccattctcctgcctcagcctcctgagtagctgggactacaggcgcctgccaccacgcctggctaatttttgtttgtttttttagtagagagggggtttcaccatgttggccaggatggtctcgatctcctgacctagtgatccacccgcctcggcctcccaaagtactgggattacaggtgtgagccactgtgcctagccgataacaaatttttttttttttaagattccatgtatgcgtaaaatcatgcagtatttgtgtttctgtgtctggcttatttcacttaacattatgtcctccaggtttatccgttttgtcccaaataacaagatttcattcttttttatggctgaatagtattcctttgtgtatatatacattttctgtatccattcaatcatgttggacatttgggttgattccatatcttggctattataaatagtgctgcagtaaacataggaggtcagatgtcttcttgacataccaatgtcagttctttggatatatacctagtagtgggattgttgggtcatatggtactgtttttaattttctcaggaaccctccatactgttttccatagtggctgtatggcacatttcttttttatgactacttcataattcacgcgatgcctaacctcctggtggacatttgggtggtttcctataggctgctattactgaccaggtgcagtaaacatcctcacactagagaaaacattgggcatttgcctgagtgggtctagaactaggatttgctgggtgggcccatgggcccaccccactggactatgaactcctaaagtcaggccagtgcttagaccacccctcccacttactaattcaggtctgcgaggtagccagagtccatgcaatgactgctatctaattgccttcagaaaaccataggtgctcaatgagagatactagtatccccttcgcaaattaaccttttgttaatatagtagcagtacttcttgttgccaagagtacataaatggacaatcttgtgtgctactggtgggaatataaataaaaacagcactgactttataagtctttctgccaattttttgtcatcatgaataccactgtgctatttgggaaggcaactgggaaatgtgtcaaaaatctaaaaattatttcacccttccctttagcccagcagttctacttctagggatatactctcaggaaacaattagggatgggcacagagactttcataaagtcccagtgctgtgtgtggcggtagaaaacagggaagtacctctgtgttcatttctggaggcctcatcctagagtaaatcatggcccatccaagcatgctggcacaaaattcatgtggagggagacttagtgacatgttctaaagcgtcccaaagagtaggctacaaaacacaacataaggtatggtcccaaatcatttctaaatgtatgtggctcttctttatatatgtggcactcttctctcctttctctagactgtgttaccaagcaccagggctgttaactgctgtctctgtagtaagaactactaatttattttttctttttttcgagatggagtctcgctttgtcgcccaggctggagtgcagtggcacaatctcggctcactgcaagttctgcctcccgggttcatgccattctcctgcctcagcctcctgagtagctggaactacaggcgcccgccaccacgcccggctaatttttttgtatttttagtagagatgggatttcactgtgttagccaggatggtcttgatctagaactactaatttcatatctttcctccccactccacctctcttctgagctccagcctcctagttccatgtacctagcctacctctccccttggagggctcacaggcatctcaaagttaccgaataggccaaacaggactttatgccctcaaatattcctcctttgttcttccatatgtcagcaaaccacacttctgtccacctacttattcacaccagaaacctaaattacctgtcaatccaacactacttcttgttggttcgatttccaagttatatctagaatccttcccactgcccccctcctccacccaccatcttggcacctgaacttcacaggagcctcctaacttgccccttcccagcactgctgtgcccggccgccacagtcacctttgaaaatgcacggctgctacttcatggccttgcctaaagcccctcaggaaccaagttccagatgtggtctggctcctgcctacctcagcagtgtccttggtgtcattgtccctcttctgccatgctcccgcctgctggctctttctgtccttccaagccctcatgcctccctccctcagagccttcacacatgctgttcccctctctgtagtgctcttcccctcactcttcatctgcatgacgcctcgtcctccttggttctcagctaaaatgtcactttgtgacccccagccttgatcaggtcccagtgatcactccagcaccctgcattctcccttgaagccttgagcaccaaggccatgacttaggtacgaggtgactttatgccacctgtagtagatggtaagctctgtgaggccagggaccatggccagtttgttcatggtggtatctgtgccagtgcctggcgcatggtattaataaatgtgtgtacatgtttgtcaataattttatttaaagaaaagtctgagcccatgttctttaaaatgttgatggtggttgtctgggtgtggaattatgagtgacttgttttgttctttgtacttttctgtgctttttgctttgttttcaataagaggcaataactgtcattttgacagaagccactgtgctggggaactggagctgtcctctctgcagaatgcatctggacttacctctgcccccttgccttctgtccccacaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcaggttagagccagcaggtccttggcactactgcatgccagaggccctctgccgggccccgggctagcctccaagtcctagactgcccatactttcttagagaagaaaccacatttaagtcaggcctgccccatggtcagtggcagagtccagcaatctctaggttggaagatgtttgagtctcaggccccaaggactcctctggacaggcatccgggactcttcctgtccccctgccccctagcccaggtccctccacttctcgctatccccacagctatacctggctctggccactcacagctctcacctggctgactttagcggccggcttccctgggctccctacacccatctccgcccttcctgttcagctctatgcagcagccagcagaccccatttaaaccattctgtccatcatgcttctgccaaaaaaaaaaaatcccccagtggcttcactgagtgaagctaagcttgtcacattgccctggggcagtcctgctgtaggccgggccctgcccaagtctcacccggtgccactcctctccctgacaccctccagctacatctacctttggtctgtttctcagtcaagcctctccaaggggccttctctgagtgctagatcagccttccccaatcacatgaccctcatcactctctgacaaggtctcaggggtctaaatgtgagcgccgggagggcagaggccttgcattctgtttggcacacagcaggtgcttggtaaccacagaccgaatgacaaaaggaaacagcatccacccacccaagtcctggctggaacacccccaccccctccattcccccagagaaccccttggctcaagtccacagtcagcctgggaatttccttgggaagcttccctgacccctgcacggctgaggcctttccctcctgctctcacagcgccacagaggccgtgtgtgcttctcacagcacagccatcaggctgcaactgtctccccgtgggctgtccggagggccacagccctgcccctccctgggtagccctagtcttcttgcccctcactggccagaagtgaatcaaaagtacagaacagagaagactttgccggggcttggacccagccctctcatgttacagatggacaaactgaggcccagagaagttggaggacttgctctgggccacccagggagttaacatagaatctggccggcttgagagagagcccccagcaccctgtcgacggaaccccaccccaaaagccttccctgtcccataatctattcattctcctctgtcacgtggcccaggcagaacctccacaggctcaccctgctcgcctctccagcatcaactctcatcctctcgccagccatagtcaagtactttgatcgctcagaagcccctgtgggccttcacacgctgcacctctgtttgcttctcccctccctccccttgcctggctgggttctcttcattcttagagacccaggcatctgctcagctgagaagccttccctgaccgcagtacccctcccagaccggggaggcacctcttctccctgctgcctccatgagcccactgagcataatggccctgctctagactgagcttctccagcacaggctctgtgtcttgtgccctcggtgcctggtggtgtttggcacatgatggaggtaccgagtcaatggctgttcattgaccgactgaatgaccagcatgtccagctgccacactgggcacgctgccctgggctctctctcaaggcttctgtgtcctcaccctcagctctggtgagctctgttctgtctctctctccctcagcagttgtagctgctggcccatgtgcccaggctctcctaacacctgttttccctgactcagattccctaaagtatgggtcctctggctacatgacattcacctgccagggtgactgacatttaaaaagggggcctgaggaaagaacagtgctcactgaaggaaaggaaacactcacggtggcgtccaggcaagagtgactggccaaggagccttccaggaagcccgcagggagcagttccgtttcacaggcggggctgcgggccacgcccactccagcgactccccaaggcagggggagtacagagttccaggcgccaccccgctgggaataaaagcaggctttccaggcagcgggctcggaatagggtcccgagctaccacccacttcctagcttgccgcaggggcacagtgaggcagtgctgatgtcaggcctctataaaccttcaggaatgctgcttattggaggaggttaaatttggtagaaggggtactagccttggtggcaggcagggctctccacccttgatccaggcaaatcagctcacctcgctgggcctcggttttctcatgcatatcatgaccctagttacacctccatgttactgtgtgcattgcacgagaaagtgcccatccatctgcagaccctggagcttgctatagggtggtgattctcctggttctgtgaagggcttagcctgaaggataaaaaggtgtggtctggttgggctggatttgaactcaggccctcagtgagcttgtagggcacctagtaacattgcacagtgtcactggggtttaagaatgtaccacctattgagctctgcccacatgccaggccccacgtggtgcaccttatgaaaagacacctgtttatcatgcagcctgaggaggaaagcatggagactggggcctgggtgtgagtttggcactcccctcaacctgcactgctggtccagtgggtggcaggagctgcctgtcccaccttgcacaggggggctcaagggaagctgaaagtgaggagacttggcttgtatcctgactcccctcagtgaggtgctccatctctgtgagcctgctgctgcccctcaccccaccaagatgtctgacaggatggatttgagaaggaggtacaacacacaccccatgatgcacggttggcccccacagactctgatgcaggccacaccctggcgctccctgagctggcctggttcagtgctctttactctcttagaagaacattggccgggcacggtggctcacacctataatcccagcactttgggaggctgaggcaggcagatcacctgaggtcaggagtttgagaccagtctggccaacatggtgaaaccccgtctctactaaaaatacaaaaattaaaaaaaaaacaaacaaacagaacagctgccatttgctgagcacctgtgacacactggggacttaacatctggcctctccctctggggaacctgcacaaacaaagcaaccttcaagagcccttcacttgatgctttaagcacccatccataatggcccttaattgactcttaattatactaacaaacactatgtgtatttccatgtaaaaagatgttacagaccaggctaaagtccataggccaccaccacctcagtccagctccagctcgtcttgctccccagggcatatccactgctatcagtttggctgggccctttcacacctccttctgtgcattactttgtgtatatgtgcccaagaaaaacctctttctctcctctccagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgtgactggtttaagattatttctccttaaccttgcaaaaacaggggttgggccttattttccccaagtccacaattagccggacttgccccaggcttctagaacatacgattctgagaagatgctggcgttctgcagaggccagcaccctccaaggccagtgtctgatgagccctcttccatctcatctgctctcaccccaactgccagcttcaggaacccaaaaggaagctttactccttaaaacctagagttaggaggggctgagagttcagggaatgtttgagcaacaaccagagaagccttatttcttctggaaggaggacagcctctggacccctcttggcccacagcattgggatctctggcctggcattcacagccacccttaggctcaggccctgctgctgagcaggctgacccagctccctccatgctcatcctgcccacatcggcccgcccaagaccaccaaattacatgccacctgctgcatgccaccagccatgggcttctttattgagcaccagattttcagtacaagttgccacagaaggagggtttcagattcaaccatgcccatgtgcaagggcgctggtccctggccagggcacataatcagagaagtgacgcggccatgccgaggtatacgtgtgtgcagaaatggacacatagggttcaggagcatcagtaactgactattgagatcatggtcttcttggaaggaataaatgtaaaaatgttgctcagccccacagagttggggtgactccacagggtgaaggcttggaggagtggcgtcttcagaggttctgccctgctcgttggttcagagaagcaaaaagatcaggcaacttgtagtacccaggatgttgtaaaaatcatagaacaccagaaccagaaaggaactccttcctatgatggcaagaagatgccttgccaagaccacataggaagaaaggagcagaacaggcctgggcccctctccctgcccttggctttgggcagccatggaggtgtccccaactgcccagacctttgggactgggcttcagaaagtctccccttagaacagcctctcaagaacttttatagaaaacaaaccgatctaatgagacgctgctcccagccagggcccagaaaccagggagtcatcacacattcatggcgctgcccaagaatggaagggcatcttgctagaagtcccacagaaagccacactggggccaggacagggcaactgcccagaagcccagacaggaacctacctgcagaggctgaaggtggcatcccataggctttatagagcaggtcgagaagctccctcttttcatcttctgggaggaaactagatttggccgcattgatgttctggaaaggccagaatggcagacaacatggaaccagagaacaaagaaggcagctcttagcaatgtagtgatagtccatcctcttcactcaacatgggcagatacgcttagagggggaaggatttgtccactgtcacacggcagcaagtgccagagtagagaccatgaggtcgtgttcttaatttgtcattacatgaaaaagggctgtgagaaggaagttggagaaacctttgagagacagggtggcatgtagggggccagagacacctcgcagacacgtgcaggaatggacttattcagcctgggatttaagaacaacctgaagagagtgtgcaagacttcatagctgctgcacacacctttctggggagagggttgacagctttcactggattctttaaaggcactcaacccaagcaaaggatcaaaaacctggtcctaggtcaggacgtcaacacaaagatgtcttctctgtggaaagtgtctaggttgggcttgtcttggactgttgaggcagactcactccctctctccaaagattccaggccccggactggacctgtagataccatactcccaaacccgagtcaaggccagtatggctcacacccactcaccagccttttaaactcctcttcagtaaagcccatgtcccgtttggtcatctggtaatcagtgtccagggtggacttgaagatgagcgggtcatctgtgttgagcgagtagttagcctggtcatttttgagcctgcagaagagggaggaggagagaatcagcctccttttactcttacataaatagtcagaacacattgacgttcacccgcctttgatcctcacagcagcctcaaacagatctgaaagatctgatccttgtgcagagggggaaataaattcagaacttaggtgacttgttcaagtctatgtaaccagaaagtccagaatccagcccatcctgaagaccagagctgggcaaaggcagcagaggggccagacatgggaaccaggcagaatggcagccggtgggggcgtgggggtgggagccaagaaagcaacatccccctccggctgccaccctctccagccttcccctctgcaccctaccctgcttgttcctcagtcccactgggagctggctactccaacataccatggaagctgttcttggcacgatccctgaccaccatcttgttgtatctaatggatctttcctagctctgaccataatcgacttgcatagcagaatttcacactgttgactgtttcttgaaaccttttccctggatttctgtgacaccacacttttgactttcctcctacttgtctcttttgctggtcccttaaataccattgtccttctgggttctatcctaggcccttcttgctccaccacctcctggggccactgcttctccttcagccaccatatctgtgcagatgactcctggatctttttccagcccatggtatacccacatgcctccaagaacctccacaggtgccacgtgtccctaaggcaagccccaagacccccttgtcatcagaacatcagagccgaagcccctccccttctcatatgcctggcagatggataagtgctggcctgaccatggtcaccctgagttcttgctgtccttgtcttggggaaggcggctttttcctaaggcctgatactgctcctgtggcttggcgacaggacggaaggagggccttgaccctggttagactccaggatgggagccaggcagggtggaacagaccctccggtggaaagcttcaagatggcgctcaggggaatgcccaggggtcccaagggccaggtgtcaggaagagagaacatgctggccagagggactcctgcttcctatgcgatgcccagggggcagagttgggagaattggaagtgtggaagcttccctcagagtaatggagcgttctgctccagctgatgagctgtagggccccagctctgctggttagcagctgggtaatcccagtcaagccacagcacatctgggcctcggattcctcatttgtaagatgaggacggcaatgcctgcttcccagggtgtcgaagagatttcatatctaaaagacgcggcatgggctgatgcccaatccctaaagtttcttccctctttggccttcctggaacaaaattgaacaggcccaggggaacagagctcaccgaatgactgcatgctccgtgtccggcttccaggcaccagtgaggtagctggaccaggggcagatctggaagagcaggtgtgtggctggcagggatggccccaggccatgctgattcctccccccatgtctgggcctggggccacccctcgagttcctgggacccgccctgctttctgcctctctatacaggaagttgggacagccggggatggttcctccccactccctggcccgcttacctcgaagtgcatgttttcctgccgcagcctgttataaagggcctggtcttccagggtgtggtagccgtgtcccagccgctctgtcttgagtatgtccacagcctgtagagaagcagaatagagccaagtatgggaggaggcagtgaggagggaccccatggccagcccaggccctcacctcttttactacttcggccgagcccacctccccggcgtggacagtacggtgaatgccgctcttcacagcctcctggaagggggagagccaggtcatgggtgccctagcgggagggccccggcaggccctgccttgaccatgctgtggagattgaaccatcctagtcatgctgcctgcttcaacagcatggggaaacctggtcttttaccctccaagtccttatctaagtggtagctgtcactcattagccagttaccatgtgtcaggtagtatatgaagtgacttgtatacattatctaatattcacaactattatcccacccattttatgatgaaggactgaagctcaggagattcaagtaatgtgaccaaggtcagacaggaagtgtggaaccaagctctgagcccgggcagtgggactccagagccctgacttctccaccatgctgcaccctccacaggaggcccattcatcatcacgctggaagcgacttttgagatgtcggctccaactcagtcatcccaatagaagaaacagaggcccagagaagacacagtgttgcccaggttcacacagcaaatcacagccagaagcaggctcagcacaggactcccaacaccaagtggaggcttttctttctctctcccttccttccttctttccttccttcctccctccctcccttcctctttttccttccttcctctctttctttctctttcttttctctttcttctttcttccttttttttttttttgagacagggtctccctctgtcacccaggctggagtgcagtcgcattatcacagctcactgcagctttgacttcctggactcaagcaattctcccacctcagcctcccaagtagctgggactacaggcatgcaccaccatgcctgactacttttttttgtatttgcagagatggatctcactatgttgccctggctggtctcaaactcctaggctcaagcaatcctcctgcctcgcctcccaaagtgctgggatcacaggcatgaaccaccacgcctggcccagggggattccagttccaagccttaagacccaacaaagacacacttcagaactcaggagacaccatggtccctggttcttgtgatttctcccaactatgggtgggagacaagctcacccagggccagcctctccattccttctcacaggacccacctggtaggcctggacatgtccaggcaagaggctgcttcctgggatggtctcatctccagccaggtcaatggctaccacggtctgctgctggtacttcttacacagctccaccaccttgggggaccagtctgtgggcgagatgcccacccaggctctgtcaccagcaccatggagagacctcccagcctacctgcctgctgtcccacccaaaccccccatgggaggccagcacaaaacagggctcagtgtcttcaaatcctaactgctatgtcctaaccacatggcctgcggaaaactgctctgcttatggcctcagtttccgcccttttcagaaagaaccctgccagctattgcacagggtcacggccaggctttgccgaggccatgtgtgtaaagcaccaaggacggggcctgagctcagtaaatgacacggacccttctctcacctggtgtttccaacaacactcatggtaggcttattcccatgcgcagatgaggaaacggaggaccgtttaacacgtcatctaaaatagaactcacactagtattgggaagtatctcgctaatgtattaggtactcttaaccaataaagttattctgaagtgtttaagaaagaatgaatgaacacaggctttggaactagatgtccccggatacaaatccagggtttgtgccttgcaagaggctgcacctcactccacctcagtttcctcatctgtcaaatgggactaagcaatggtagttctgctttgcaggctgctgcgaggattagaggaaatgcgtgcaggtagctctttggttcttactaatcctgagggtagaggaatgaagtaagtgtgatcatctccttgtgacagtgcacaactgaggtgtcttggtgcataaccagagcagcagtgtgacctgcccaatatcacacagtgaggctgtgcaccatgaggcacaaactctagagatctgatctgcgtcagtgacaagggagacccctcagaaatcttggaaatcagacctattcaggcccagacaggatggggcctggtccactgggtctcgagggaggactatgggctgatcagaatctagcctagatttttttttcaatagttacgttcctatttggtgttgagcttcctgcagggtggctataaaggcatggtgtccctggggagaacatctccagaagttctgagcctgcctaggaggtctccagttgtttcatgaagccccaagttcatgccagtgggctcaaggggacaccatggggctgtggggcacaggggagatcaggtacagccccactgctaggccaggaggtcagggccagggtgagacgggcggccctgggcagggcggtgatcctactcactgggctggtggcgcatgcagcacaggatggaccgggccttgaccccgaagtctcgctccccctcctgcaggccctggcccactagggccaccacctcgtctggggtgaggtcccctctgtgtgaggagaggagtagggatgggcctgaggcaaaaggaaggcctaaagggcagctctgggactgggacagaggaggaagaggaggctttggggaggaccctcctcccccactgacccactgcctcagaggaaagactggcagagatgcccccaggccctaacatgtccctctagctcttaaagcagctgggtgctcctagatcttagtgggaggtgtggggtgtcaacatggccctccccacccccagatggacagcattgctaagcttgggcctgccatgatgttcacattctatatgtatcagaatcatggctcagaaaatggggcagggtggttttgtgataccacttagagatccatgggggcccaggcagggggctagaaatgggccagactcacttcagttatgaagttagagcaggacctttagggcctttagagatctgatcagcatcagtgacaagggagacccctcagaaatcctgggtggctaagcaggttaacattcctggacagcaggcctgtggccagagcaagacacagccaaacacttgtgcccaaggtaagaacataacggcaaagggaggatgggaaccacgtctcttgtgacagagttaaacccatctttctgaggccatggaccagactgggggcaagaacaaggtcttgcttgggtcagggattcccagcagttcgcccttccagtctcagagctgagcctcccagccacaccctcagcatggccccttccaggcccatcactcactcagcctggttccaggggattggctccactttggagttggccagcaggtgcggactgtaccgcacctccacatacaccacgccctctttggccttcatctctacaaactcataggcgatccttttgatagcctcccggcagcccctgggaagggaagaaaggggttgggaacaaccttccccaagtcccttgggagctccaggagcaaatgacatccccaacccttggcagattaaacccacttcatcccccagacccaagctctgggcatccactggataagatcccagacactgggcaagtcctatcagctctactttggaactgcataccagttctcacccctccatcctggcctgaatcacgccatctctaactggcctccctgtctccatgcttgcccctgtcatcctgttctccacccagcagttggggcaatcttttaagaaggtaaatcaaagcatatcacttctcccctcgaagccccagtagcttcctgccacggagagtgacatcgcaactcccaggtcctgcccacaaggcctgcatcctccaggccttgccagcctccccagcaccttccttctccctcattccctgaggccaccggagaagacacaggcctgctcttccccgatactgtcctacactgcgtctctcccgctcccctggtttagagccagctgaagcttcacctcctcagagaggccttccctgaccaccttatcttttttttttttttttgagacagaatcttgctctgtcgcccaggctggagtgcagtggcgccatctcagctcactgcagcctctgcctcctgggttcaagtgattcgtctgcctcagcctcccaagtagctgggattacaggcgcatgccaccacgcccggctaattttttgtatttttagtagagacagcgtttcgctgtgttagccaggatggtctcgatctcctgacctcatgatccgcccacctcagcctcccaaagtgctggggatacaggcgtgagccactgtacctggcccagaccgccttatcttaaaacggcccctccaccattctcctgggctttctttttctcccaggtccttatcactactcaacattgtgtgtcatatggcttatcagccagtttgctgtattccctactagaatgcagtctccatgtggcaaggacccctctgtcttgggatggctgcgacctctcagctgaggaccatgcctaggacagagtagcccaatatttgttggtgatggagttaaggctggcagggaagagaaatgagagaaaaggacacagctggacaagtccagagggatgcctggatgtgggagacacgtgggatacagtcatggacttggatccttgtgcccacacttatctgctgtgtgacccctggttagtcaccctctgacacctaggtcaaggagttattgcggggacaaatgagtcaaacttcataaaccccacccgggtcagtgcttggagcagagcggacaaatgctcaaaacattttcgttgttattactgcatgtttgttccagaagcaaggcacaaattggcctgccagggccactgtgttgatcacgtaacggtggactgtgcttagctggaagttcccaccatgaagagtgaaaatgaagtggttactagaatgtgtgagggaaggcacacaagtgctgggagagcccagcgtgggaagaaagtgccctgcccaggggagatcaggccactctcaggagaaggggtcaccagaagttcttgcatcttcaggatgaggatggaggccaggcgcagtggctcacgcctgtaatcccagcattttgggaggccgaggcgggcagatcacctgaggtcaggaattcgagaccagcctggcaaacatagtaaaaccccatctctactaaaaatacaaaaccattagttgggtgtgatggtgggtgcctgtgatcccagctacttgggaggctaaagcaggagaatcccttaaactgggaggtggaggttgcagtgagctgagatcgcaccactgcacttcagcctgggcaacagagtgagactctgtctcaataaataaataaataaataaataaataaataaataaagcagtcatggaaatttctctctagtactcgcccataccccttctgggccttttcggtacctagtgctgttccctggcgactcaagacaagaaaaagaaaaagccttttggagaatcttccccacatctccccgcccccaccctatattcaggcctctcctcccctcacaacacgaagccctgaactaggagatagatggcccgggttcaagccctgcactgcctctgaccctgtgttcttagctcccatattctgccatttctctgtagaacttgaagcaatttcagtccatcacacccacatctcagaagggaaaactgaggcctaaaggcactggagagactcactaagtgtacacaatggtgagaaagacagctgtggtttcagagcaacttctctggcccccacaggctgagggacaggcctggtcctagtcatagggatcaatgctgccctaggacctgtgggttgggggcaactcacgcgatagcaggcatgtagtagtcaaacttggccaggaagtctggaagggtgagcggcttgtccatgccaatgacgttcagcagcccctctgctgtgttagctgggagggcgatccctctcctcctggaaacaaaacagtgagtggtggaccaacccggggcaggatccaggcaggcctgacaggccaggatggagcagactcaggagcgccagcctccttgcaggaccacagcaggagacatgggcgtctctcagtccagctgctcccactggacagatggggaaactgagaaccaggaccggaatttttccagcaccttctacccccaatgcacaagtcagcaaatctcaagggggataaacaggttgaagtgtgtgtgtgtgtgtgtgtgtatgtgtgcacacatgcacacaccccctccatatccttggttgactgatgcttggagacaaggaaagtgccaggtcaagttcatggcttcctcctcagccccaggagctggctcagccagctggtcctatgcccagtcaggggttatcaggggcagtaactgcagcatcacaattcccagggtaggggcaggcatcaggacttcaccctccatctggctggcacatcagaggcttgcccagcccagcgcactgggagagggccggtggaggctcaggggaggggcccagtgggccgccagccagctcagacctctctcccctccctgcccacagccgccacaccaagctggactacagcagcgctcagtaagagcgtgctggaaacagcccctctggcttggagcctccatttctccccaagcatctcggcctcccctcccagccacgggaagcagggtgcgagctcaggggggctccctctcttctgcacacgctcctgcctcctcatcccatcccggctctgctccagctcacaaggtcacctcgagcctcagtttccccccccttttttttttaagatacaacagccagagaacaccagacattaagaaatgcttctaggctgggcatggtggctcacgcctgtaatcccagcactttggcctcccaggccaaggtgcgaggatcatgaggtcaggagattgagactatcctggccaacatggtgaaaccccgtctctaccaaaaatacaaaaattagttgggtgtggtggtgtgtgcctgtaatcccagctactcaggaggctgaggcaggagaatcacttgaaccagggagtcagaggctgtggtgagccgagatcatgctactgcactccagcctggtgacagagcaagactctgtatcacaaaaaaaaaaagaaaaaaaaaagaaatgcttctaacatgagggacaaaacaacagaatagacaaaagcactccgaggaaacagcacagagaacagatgaaaacctaagaaccaaaacaaaaaagacatgaatatcctcaaagagatgagaagatccttgaaaggagggaacattcagaacccaagaacgagccctcggaaatttacaagagaatgcggcagcaactgtcacgatgtaagaaaagaactggaagctaaaagtgaagaaatcctccacaaagtagaacaaaaagacaagatgatgaaaaataggagtaaacagttaaggaaattagaagattaaatcaggaggtccaagcatccaattatccacaaagcagaagcagaaaaataggaggccgggtgcagtggctcatacctgtaatcacagtactttgggaagccaaggctggcggatcacttaagcccaggagtttgaaaccagcctgggcaacacagtgaaaccccttcaaaacaaaaattcaccaggcgtggtggcgtgcacctgtagtcccagctacttgggaggctaaggtgggaggaccacctgagcctggaagtcaaggctactgcgggccaagattgcaccactgcactccagcttgggtgacagagcaagaccctgtctcaaaaaaataaaaaagaataaaggaggaaagtgccaaagaaacagaagtttgaccaaatagtgttttagtgtatgtaagtaagtttgtaagtcctttaatagcttctgttactaaaatattaaaatgcttccctacataaatatgtttcctaagccccctgaatgtgctcccttccccatctgttagcccaagtccccatgagtgcccagagggtaccaccaaggggtcatgctggtgcccaccagcctgctagtcagcccctaatcactgctccttaccagcccctaatccctgtaagagcctgcaggggaacggtgccctggtgcggcattggcacctggaggtcggagctcagtgcctcaggtacccctgagactgcttcccctcccactgctggccagctgccccaaagtcaccctcacaaggccttgcccagtaactgtggccgctgaagagcctgtaccagttgtcaaacactgttggggatatcactctgggaactgctgggtagaaggcagggagatgacactagggctctggctcccatattgccaaacccagtggccacatttgcctgggacctgctgcgccagccatgtgcgattctcctaatggtctccctccagcccccagaactccacctgcgggggctctgccctctggtcgttctctctcagactctgccttttacacacctggccaggccaactcatctcctttggtggttttcagctccggatccagaggtccacagcttctaattctctatgcccatacaccaccactgagggcctgtgatgtgctgggcactgggcagatagcagtgaccaagacagacccatgtgtctggctacctgttgagaggcaggcatctcgcgccacctttcccctccctctagatcactcccttcctgggttccacatttccaaatacggctcctccatctacccagctgcccacaccagagacgggcgcctccccgtgcccagcaccagcccgtcccctagaacaaattattttgctttctatttctcctcttcgattcttcttctccagcctccctcctcaacaaccatcaagaaggaacttctcaacacagagtttagacagagcagccagggaaggcctctctgaggaggtgacatttcagcagaagccttggggtgggggcagttctgggcaggggaggggtctgtactaaagctgcaggcaggaagccgcgggcattggaagtgcagggtggctggaggtcagagagcaggcatttgtgcagatgatgcaccagggaggcagggccaggctgggcttaggaagggactggggctttggctgaaagcactgggaaggcactgtaggatttcaagcaggggactagcatgaaataatttacctttttgaaagctcctctggctgctgcgtgggaaacaaattggagggaagccagagctgaggccagagagctaatgtgggggcccgacaggagacaaagagcacaggggactcccagtgtctcccatgggacacagcttcccgaagctgctcagactgagctggaaagcgcccatctggagcccaaagttgaagcaggaaagagctgttcctagggccctggcacctcttgctgtccctggccacccacacaagcgaaggctcctcatagggccaccctctgttttttcttttgttttgtttttttgagacggagtcttgctcttgttgcccaggctggagtgcaatggcacgacctcgactcactgcaaccttcacctccctggttcaagtgattctcctgcctcagcctctcaagtagctgggattatagatgcccaccaccatgcctggctaattttttatatgtttagtagacacggggtttccccatgttggccacgctggtcttgaactcctgacctcaggtgatccacccgccttggcctcccaaagtgctgggattacaggcgtgagccaccatgcacgctctgttcttagatgatccctactccctggtcagccacagctgctgtgctggggcactgtctggtcctcttccggccttggtgggcaacacagtcacaagaagcccaccatcaggagcccagggagggagggaggatgagctcaggggttgcaggtcaagtccatctcccacccctatttaccacatcatcccaggcaggagcgctcccctctaaggcccttggtgcccttgtcagtaaaacataatattttccatgtaggggtgcacagaggaagaaatgaaactttgtgtgtcatgagaaagagcagactctgaagcccagtggtctgggtttgaatcccagctctgtgacttaaaggctgtgtgaccttgggcaagtaacccagactctctgtttcctaggtctggcatgtttgaaaaacatccagtgtggactaagcaaggagccttagagaggtcagagaggcaatgcaggctttgcagaactttaaggcccatgtgtggactttggctttgactctgagtgagatggggaagctggggaatgagctgggaagaccatgggttaaggctcttgctccaactacagcactgcagggcccgtagagaggaaggccagagtagatggctgagaccaatcaggaggccacagcaccagggaggggcagtggtggcccagaccagggcagtgatcggaggaaagagcagccagtttcagaatctctgtagaaatagttgacagggttataaacaagactgagaaagaggttggagaggcccctgaaaaggccagaatcctgggaactggaggaaggagaaatgggtgaggacagttaatgaggcaggcctgagtcccagagctggaaaaagggccactgaattgggcctagcagggctcaggccaggggctcccctcctccttccattcttagcccatatttgtgtgcatttacagacacccatatctgagtgtgacaaactccccagtcccctgcctgctgacttcaggccaagctccagctggcacctgccgcacgccatctccaaggcccagaggtggtgtgaggaatggacgatcagaccagtgcccctcccggcggctcctttcccctttctcttagccccacccggcgctcccagcccctggctgcagctgatgagccctccgtgaccccttaatgagtgcctgggttcgatctcatcttggtgccccactgaacgacctcattaggggccttgtggcaagttggcggcttgacatgggcaaaggccaggcagagataagccaagaggtttcaccccacttagagatataagctccaattaataagaatattatcattaagtgacatttatggagcacattaatgtgtgctaggccctgaactaagcattttacgggcgtcacttaccaaaacctctaactgacagggggtaatggccagggccatggactcgggggcagactatctgggttcaaacctccgccctgtgcttactgggcaccttactccacctaccacggctcagtctcctcatctgtaaatgacggcaatagagttcctatcttacaaattgttgtgaggcttcaataacttaacccgggtaacgcacttaaaggagtgtttggcacacaggaggtgctactgtgcttatgccttgcagttaaataggaattaaatcaatggcagcttcctggggcagaagaaggtccctggaagtgcgaaaagatggagaatagtggacttaccagaaatctctcagggagttggtggagatgctcccgagagttgggggcaaccccccgggatccctcattctctccatgagggcaggcctctgaataacaggattctggcttatggagcagaaatgttcaaatttgggtcccgagctgaatttcaagactgtgacagagaggctgagttctttcagctccaaacaaaatgagtgttgtgcaaacatccgaggaacacaggtctgcgggggcagggctgggtggacaaggagcccctagctcctaggtcatctctctagggagggcctgttcttagcctcagttgatagagaccaagttcgcagacaggagataatatgtccaaatttgaatccagatccactggcctttaaagtccctgcccttaaaagctggtcctaagagaggagctgctgtgagcccttgaggtctgggtaggaagggaagaaccttcctcgctggggaacagggggaccctctggccccctagcatctctgagagctgaggcaggaagtgtgttctcacttggaagatgcagagatttaggcccagagttggggagccacttttccgtgactcctagcaggttatgaccctgatgatgtagtaaagccttaggggtcagacagccttgggttcaactcttgatctgctattaatttgtgtgaccgtggacaactgtcttggctgagcccattccctcctcagtaaaatgcagagagcgtatcctcctcttccaagcgtggaggaattcaatgagctgataaagcccagcccagctctaggagatgctcaagaaattgtactggcatctcatgtgagcacatcacctgctatatataggctctcagttaagtcaaaagacaggagccaggcacagtggctcatgcctgtaatcccagcactgtgggaggccaagctgggtggatcacttgaggtcaggagttcgagaccagcctggccaacatgtgaaaccccatctccgctaaaaatacaaaaattagctggatgtggtggcatgtgcttgtaatcccagctactcaggaggctgaggcaggagaatcacttgaacccaggaggtggaggttgcagtgagccgagatcatgccactgcactccagcctgggcgacagagcaagactctatctcaaaagaaaaaaaaaaagacggattcagccctgggaactaccttcatgcacgtatgtgggtgggtggggagagcaggctcaggcctggctcacctgacaccaggaggacaagactcagaggcccagaaagctcaggagttggtctgcgggtctccagctcagtgctgaggcctccatgtcctcacagtcccacttctggcctggagctggcttgattcccacagggagacaggaaggaacagtgaccctggaattccccaggggcctctgggtggagctggggaccccactcaaatcccagggagagagggctcttctgtatggacttacctgccatagtataagatggtttcaggcttgatggatccgtctaggtggacatgcagttccacctgcaagggggcagggggaagagagagagaaagggagagagagaacaaatacctatgagttcacgaaggacctttcagagcttaatgttaacattaatcatgataaccattagccaccattttactggctggctgctgaccccatatacttcggtaaactctgtactgcactatctcatttaatccgctcctgggatgtgggttcagctgttatctcgatctctttcacaattgaggacactgaggttcggaggtgttaaatatctcatccaaggccacacagattgcaagtaatagaggcaggagcccaacccagtatctttgttcttaatcgcagctggtgagtggcagaggcggaattctaacccaagcccaattccaaagcttgtgctccaggtcacgtaggcagctcccgctctcagccaactaaataaactactttaacaaaagggattgacccagatgtcccaaactagggaagagtcacagcatatttcaaaattcaggatccattttcgttttcttttttttgagacggatggagtctcgctctgtctcccaggctggagtgcagtgacatgatctcctctcactgcaacctccacctcctgggttcaagcaattcttgtgcctcagcctccggagtagctgggactataggcaggtgccaccacgcccagttaatttttgtatttttagtagagacagggtttcaccatgttgctcaggctagtctcgaactcctgacctcaggtgtccacccacctcagcctcccaaagtgctgggattacaggtatgtgccaccgcaaccgacccaggctccattttcaaaagcagatgctactcaagcatagcctatcaggaatcaatattaggcaacggaagatctttctagtactctagagtttaagagtaggatccttggaggcagcccatctggcttgactcccagttctgctgtgtgacctcagacaagacacttgacctctctgagcctcagtttcctcaactgaaaaacaatggaatattatgcccccgtgtccaagaaaaattgtaaggattaaaaagggcagtgtaggtggacatggatagcccaaaggaaacagcccctgccgctcagtcagggtgtttaccatgagctgttaggagaagcacagcaggcagtgggagatggtggggaaagggactttgctgttcctgctgttcctgttccaaatgatggaagctttccccctagctaggggagatccagaaaactctcagctgacatctcatgctggggtggggagcatggagagctggataagaaagttggctgccctggctcagggaggaacagccaaggagctgctggcccaagggcgtctaggagcacatacatgagctgcctcctgcagaggaaacccaacccaggcccaggggaggccagcagggaacagagacaccagaggtcctatcagcaggacctcagagtcatcagatctctcctgaggtcatccagctggcaggggacagagcggtcttcacacccagtctcagggccaacttagttgttgaattccctgacaaaatgagttcagttcccacccagccaaacgtctgtttctcgggttctcaaaatatgctcagcattgggaatactgaagcttatagcccagggaacggccaaccagctgtgtgacctcaggcaagggacctcaactctctgagcctctgttttctatccttaaccctcacagggctatggagagggcccagccagagagccggagtcacactgtatagagcatcatgcggttagagctggaatctcggctcctccactcactccctgcttgaccctgagaaagtcacttcacttcctgtgcctcggcatcctcatctgttaagtggggagaatggcagtccttccttctaggcttcatgagggttaactgcattagtaggcagggagttcttggcacatagcaaatgctaaatagttgtcaactaaaagtcaatgaaggctgggcatgggggctcacgcctgtaatccagccactttgggaggccgaggtgggtggatcacctgaggccaggagtttgagaccagcctggccaacatggtgaaaccccatctctactaaaaatgcaaaaaattagccaggcgtggtggcgcacacctgtaatcccagctacttgggaggctgagacaggagaatcacctgaacctgggaggcagaggctgcagtgagccgagattacgccactgcactccagcctgggcgacaagagcgaaactgcatctcaaaaataaaaaataagaataaaataaaagtcaacgaaggcctgcgctcctgctggatgctagattgtagagttaaacaggagggtccaagtcctgttcctggggcttgtacaggccccagagtgggagaggcattaagcaaatgtcacatgggaaaatgtacagtcacaaaccaagacgactccttgggaagtacgaacacagtcctatgacagagggtaacaaacaagagaagtgaatacatctagagggccaacaatgagcctgagcgaaaagctagaggatagcgaggaacccacaacacaaggcaggggtgcggagggaggcaggaagaaaattccaggcagaaggaacagcatgtgcaaggccctatggcaggagaaaacggggtatatgaaatggattaaatagaggttcagagaagggagggttcatggtactggagaggctgcaggataggaccacccaggcagggctgtgcgggccacgaggagtcaggctttatctggaaagcacacagaggccattgcagggttggcagctggttagagaaagaggatggctcctccaaggccagttagaggctactgcagccatttgaaagatgacggtggcttggaccagggttgtgaggtgcatagaggaaaaacaggtggatagaaagagatgccaaggctcacacttcaggttaggcctgggtggggagcaattcccgcagtttgagacagagaactctggaagagaagaccaagtcctggagctccctccaggagggaggatgcgggggagggaggcatgattggtttggttttagttatgttacactagagacaccttttgttttttgtttttttaagacggagtttcactctgttgcccaggctggagtgcagtggctccagctcagctcacggaaacctccacctcccgggttcaagcgattctcctgcctcagcctcccgagtagttgggactacaggcacccaccaccatgcccagctaatttttgtatttttagtagagatggggtttcaccatattggccaggctggtcttgaactcctgacctcaagtgatctgcccacctcggcctcccaaagtgctggggttacaggtgtgaaccatcgtgcccagccaactggagatgcctttgagatatccaaaggtaagtggaagaacccagtgggatacaagagtctagagctggcctgagaagcccaagctgggaatgtaggtaggagtgtgggtaagcacagaagctgtgggcttgaaggagctcacctagggagaaaatatcaagggaggtaaggaaaaggcctaggatgaaactttgaccagcacaagcacttaatggccttacggaggaggctgagcctacagaactgtggccagagaggtgggagggtgtgtggtatgcagaaggccaggccgtcagatgtcaaggagaagcgagcaacggttcacagggttagcatagtgggctgaatggtggcccccacaaagctgtctacatgctaatcctaatccccagaacctgtaaatattaccttatatgggtcgggcgtggtggttcatgcctgtaatcccaacactttgggaggctgaggtgggtggatcacttgaggttaggagttcaacaccagcctggccaacatggtgaaatcccctctctattaaaaatacaaaaatcagccaggcatggtggcatgcacctgtagtcccagctactcaggagactgaggtaggagaatcatttgaacctgggaggcggaggttgcagtgagccgagattgagccactagcactccagcctgggcaacagagcaatactccctctcaaaaaaaaaatattaacttatggcgggtggatcacctgaggtcaggagttcgagaccagcctggccaacatggtgaaaccccatgtctactaaaaatacaaaagttagctgggcatggtggcaggtacctataatcccagctactcaggaggctgaggcaggagaattgcttgaacctgggggcagagattccagtgagccgagattaaatcactttactccagcctgggtgaaagtgcaaaactccacctcaaaaaaaaaaaaaaaattaccttatatggcaaagtgtgattattaaatgtcttgacaggaagagtttatcctggattatctggttgggccctagatgcaatcacatgtatccttataagacagaagcagagagttttaagagaaacacacacaagaggaagcagcaacgtgacctcagaggcagagactggaatgatgcagccacaagccaaggaatgcctagagccaccagcaaccagaagaggcaaggaatggattcccccgagagccttcagtgggcatgtggctctgatgatatcttgatgttggacttctggcccccagaactgccagggcacacgtttctgttggttgaagccatgcagggtgtggcaacttgtcacggcagccacagaaaactcacatggtcaggccctgctggaggtcacaggatggaagggcagaaacttgtccgtcgggctaaaagcgcaggcactgggggcttcagaggagtagttcttaaccccggctgcaagttaggagcacgggaagttctggccagttcccaaggcctcaaccccatctgaggtcaattaaagaaaaatccttggtggcaggcccaggtggaggactttttttaaaaaaacacgtagtcaagattgggaaccactgccgtagaggaaccgttctagaggcctgagtgagggtagaatccacatgggaataaggtaagaaagaagtggaggtaagaagaggaagaaggtttagactactctttcacaattttgcccctaaaggaactagcagccttggagggggcaggacgtgcatgtgggtcaagagaatggcaggctttttcaaaggggcatgtcttgggcaagtttaaacacccatggggatgattgaggctgagtgaaaggagttgcatgaggttactgggaaggtaggaggaagtcagaaagtcagaaggtcaaaccaggcctggccttggagcccctgagaacaggaggatcaggcagtgaatgggggcggtagtcacgtccgcttgtgggtgggactggtggggggaggtctgcatggctacttctggctaaagtatttattcatttatttatttgttgttgttgtttttttttttttgagatggagtctggctctgttgcccaggctggagtgcagtggcaagatctcagctcattgcagcctctgcctcccaggttcaagggattctcgtgcctcagcctcccaagtagctgggattacaggcgcccaccaccatgcccggctaatttttgtacttttagtagagacagggtttcaccatgttggccaggctggttttgaactcctgacctcaggtgatccacccacctaggcctcccaaagtgttatgattacaggcgtgagctgccttaccctgcctggcaaaagtatttaaatgccaattcaagagcccacctcccagctctgctttactctggcacaacaattggcaatgttcagagtggaatcttcccatctgcctggggccctgagtgatccaaggagccgaaacctcactggaggccctggagggacaagcagtatgaggtcaacctgggtctctgcagacccctcagacctgggggctgtttgttaccacagcagcacaaggtagcctctcctgcctcagaatgagcaaacacacctttctgaactcagccttgcaaactgtgataagaagcagaccaagtgctatgagataaagaaaaatcacactggggtgggggcaatttagaaagtgtgttgggaaaagatcacttaaagggggagttcgccagggagaagaaagaaggagagggagaatggctccaggcaggggagctgcgtgtgcttagtgtctgaatcaggaagcaggcggggagttggccagagtgcagagtgaggttagtggtgagaaatgaggccagggcaaagtggagagggggcagggagattgcagaggccgaagcaaagggttttccacccaagtgtgttaaatcggagagtcccctttaaaaaaacctttcccggctgctgtgtggaggacaggatggcaggaagccagaacagaagaccagctactgcgggagggaagatctgattgggatttgaataacatgcgggaagtactcaaggcagcgtcagagacagtgggtgctcagcggggcagaagccagacagtgccggggtgcagaagctaggggttcagggagctgggcaggaggcaggagcgcctctgggaagggggaaagcagagccagctgcccaccatgaccagtagcactcatcccttctcacggctgcctgagaagaggcccagacgcgtttcaggtgtggagcagaggcaggaagccacctccacaggtggctcaagctcaggcaggcctcctactgaattttctagaaaactgcaacacaccatgggaagtctgtcagcctattccagatgacaatgacaatggggtggcgaccccgctctcctgtctcctttcagggaaaagggtcagcagtggcctcaaacttttgagtatctactatgtgctagaccatctatatgcattatcttatttcatccttacaaccagcaaggtagagacttcactcccattttactgatgaagaaactgaggttcaaagaagtaccccaaaacagtcagtgatggagtcagaatttgaaccctagtctgattcttgagctcctaaccactctactgtactgcctctgtgggcctagcctcagacatcaataatacagaaataataataatgataaagcagctacctactgttttcagaccctttatctcatttaatccctaggcaatgtacatatcggcccatgttacagatggggaaatggacttgccaggctaagcccggagaagttcagtggcctgtccagagttacacaaaattgatggtggtagagctagggtggaactcaagtccctctgcctcagcccaagccctgcccacaggccacaccccctccctggcactcatgtcgagacagtgcctggcctcctgacctctccagaggggaatctcacgccccttcccactgcctttgctctctgcaaggctgactcacagccagcccagcatttgtctgaacagcaggaaatcctcccagcgctgatgtgaacaggaagcatcctcagttaccaacaaatatttactaagccccactatgtgccaggcaccgtggaggccctcgggaaatgcactaagtccctgctctcaagagatgcgtgccagagaggtccagggcggtgggttcacttacccaaggtcactcagtgtgtcggtggcagagctaccatgaggacccaggtcttggactcctgggacagatactcccagatctgactcatgtttccacgttcccaactgctggagggcgagcagggccgtctacctccaaggcaaacctagtcagattagttctccctggtgagccttggggacaactaatctgactgggtttaccttggaggtagacgccctgctcgcctccggcagttgggtttgcctcccaaacacatcgctctgttttgttttcgtctgactttttgggttcatgtatgtaacatgtctgtctccctcatgagccgtttgctgagaggggggaccttgtctgtgtcatcatgtcgtgtcctcagcacctcgcacagcacctagtgctctctgtgttcaatgaccacaccgttatttcctcgtttccctgtcccatgtcagcaatgctgggtgctctccctgcaacaaggaaggggctgacctgcccccatgggacctggcagaacccacacgggggcagaggagccagggctgcctggtcagctcacagaacctgagcaccgtggccagaacccagatgagccacaggtgcccactgccaatcgaatgtcccctccctccctagccctgcttttggtgatgagctgggcagtgccagggtcagtgacttatgccactatggcctctcaactgacttttagtgtgaggccaggagacagagcagccctgggctgagaaactgtttcagctccacttcctccaggaagccctctatgctcagcctcatctaggctccgccagctccgaggtacacagtggaagggactgagcagtccccacagtgtctcctgctgacggggcctgacagctctgctgctgagaggtttcacagaaggcaagatgtgtcttccacctggggaaattcctgtggagccacagcatagggactcagcacacttaaactcgttttaaaggcaacaagactgaggctcagagagtgggaggaccttgagttagaaagtctaatgcataccacagccaggaagctatttgactctaaacccggaggtctagcagcacgctccctgcatgccacatagcaaggtgctgggtcactgatgctaacatctaaacaggggccaggtgcggtggctcactcttgaaatcccagcactttgggaggctgaggtgggtggatcacttgaggccaggagtttgagacctcctcttcacagaggtggaagggaggaccagcgggggcaagtgtatcccaagtcccagctacttgggaggctgaggcaggaggatcgcatgaacccaggaggcagaggttgcagtgagccaaaatcgtgccactgcactccagcttgggtgacagaggaagactccagctcaaaaaaaaaaaaaaaaaaaaagtcactgaagtcacctggtacccaggactacttcaaggacagccattgttatggccaacatggtgaaaccctgtctctactaaaaacacaaaaattagccaggcatggtggcgcacacctgtaatcccaactacttgggagactgaggcagaagaatcacttgaacccgggaggcagaggttgtagtgagccgagattgcaccactgcactccagcctgggcgacagagtgagactctgtctcaaaagtcaaagtaggaccattaccaaccatgatgatgatgctgaccaatggcagctattgctgcagcacctgctctgagccaggcctgcacttggtgtttgagaggtgggtatgggtataattctcattttagagaggggaaactgaggcaccgtgaagttaaatgactcattcaagctcctctagctggaaagtgggaaatcaggactcagacccagagagcctgaccccagctggtgtccaagttcaaattccttgctgttctagctccctggtcactaggagtgcagaggttatcccccacaactgctcaggggcctgagaacattaagggctgagggcaagcctacccccaacaccttgggtaaatacagattccaacctcactctgcgcccacagcctgctcctctccacctccccagccagaccatggtcctactaccttgccccgccccagggggtaccacagggaccccttcaagacacctgagcaggtggacaagtctctcctggatcacagggcccccagccacccaggtcaagcccaccctgaggttgaatgcaggattgggaagctgcctggcctcccctgcctccctgtgtgaacacagaccacttcctctctctgatcctcccttcctcctccgaagcaaaaggcttcgatgaaactcagtctcctttgttcccctccaccaccaactgccatgtgagtcaaaatgggtaaggcaggctcttcctaggcacatttttgttttaacaggtggctctggtaactgaaagccactgcaagcccaaagaagtgcagctggtgggttttgtgtcaggaagacaaaaaggaggagggaggagggagattctgcagctggagaggcctcccagagtctactgcaacccccactccagtccccaggaaggaaacgcacccctgagggcctgctgttaccagccaggcactgtacaaaaaccaatcagcatgtcagtttccccaagaaccccaagatcttggttttgtcaccccattttacagagggggaagctgagtttcaggagttgtctacctgaggtaccctagctgctaagcggcaggcaggaattcaaccccagtacatctgaagcccagggctaatgcactggcccaccctgccaccctgattctaactcttccccccacactgccccctcttttttgcataaagtggaattggcaaatgagcaaagcaatgaacagcttctacttgagtgcaggcagatctgggttcaagtctagctctgctgcttgccagctgtgtgactttggcaagttccctcccctctctgagtctcagtttcctcataataagtgaagttaataataggacaggaccttcctcagagggctgacataaacattaaatgagtcactgtatgcaaagcaggacagcgcctcgtgcagagtagacattcaaatatgagacagaaaaggcacattgctgatttagccccaattcccctctgcatcagagagggacagtttagaaactgctgtcccttggccgggtgcggtggctcatgcctgtaatcccggcactttgggaggctgaggtgggcggatcacctgaagtcgggagttcgagaccagcctggccaacaaggagaaaccccgtctctactaaaaatacaaaaaattagccgggcatggtggtgcatgcctgtaattccagctacttgggaggctgaggcagaagaatcacttgaacctgggaggcgaaggttgcagtgagccgaggtcgtgccattgcactccagcctgggcaacaagagcgaaactctgtctaaaaaaagaaaaaaagaaagaaactgctgtcccagcctgtacctgttcacttgccagtctacagcttcaaggctctcagattttgtgtagccctggcaagtccctccactccctaagcttcagtttcttcatctgtaaatggggatgaagacccatgccttgtcaagtcgtccagaggattccgtgagataaaagttactagccgggcacagtggctcacacctgtaatcccagcgctttgggaagccaaggtgggaggatcacctgagatcaggagttcgagaccagctggctaacgtggtgaaaccctgtctctactaaaaatacaaaaattagccgggcgtggtggtggacgcctgtaatcccagctactccggaggctgaggcagaagaatggcttgaactcgggaggtggaggttgtagtgagccaggatcacaccactgcactccagcctgggcaacagagtgagactgcggcacacgcctgtagtcccagctacttgggaggctgaggcaggaggatcgcatgaacccaggaggcagaggttgcagggacccaaaatcttgccactgcactccagcttgggcgacagagtgagattctggcaaaaaagaaaaagtcactgaaggcacctggtacccaggactacttcaaggacagctattgttatgattattgtaacaggcatgtgatcagcactggcctccaggatgcagaatgcctgagtgcctggtgccacctgtgaacataggctgataagggccacccctgcaacccccctttccacttcttccagtgcccagcaggtgctaagtcaaaccaggtgggggtatgggaggcacacccgacagggcaaacttgacttgggcatcccctgacgatgaccctgcatggcaggcacacttgaatgggtgttcagagttctgagcgaaggaatccaagagtggccaacctggagatccagtcgttatctatgaggaacatctgagccccaccccattcccacgggacactgaccatacaggggtatagggaccgaggccctttgttttgggttaaatgaaggttactaggtggagatggttgggagaaggtgttaaatgaaaatgctacataaactgcatgatttgcaagtggttgcggttcttctgctcagtctgccgccactggactctcttccctgtgtctaagcccccagtaaaaccccgtatcttgtttgctacctcttccaaagaaggtagcctcttgaacctggtgctatatccattggagtcaataggggtcccgcacaacagaaggcagctgcctagggccttgctaagcaaagtgtgttcctggatcgttgacattagcatttcctgggagctggtcagcagtgcagcatcgcaggccccaacccgacccacacagaatcacagtgtgaacattaaaagtcaggccacttgagtgcagtttgaaaagcgctgccctgctctgctttcttctagctgaccaggtcccaggcctcagctggtggcaggtatgagaagctgaaggacacagcaaaggctcctgtctcaggaggtttgcacctggggcactggcacctctatccccaaaggcttctgcagaggtagtttaggaaagatggttagaggcatgggatttcgaagccagcctcccttggactcaaaccccagattggacatttcctagctgtgtgatcttgggcctagttaacctctctgtgcctggattaaataaaaaatgcagataatgtgtttagaacggtgcctggcacagaaacatcaacactccattagctgcagctagtaatgctaataattataactgtcatctgtccctcccacaagagggcagggagctggctctggtcacagtggctctgagattcacactccttcccacttctcctgccagctcacacaagttcctcctcacaatcatacaagatttgtcacgcctcaaacacatggcaggtaacattctaccttcactctcaagcatcaccttgtggccttgggactcaggacacgggacacccacataagcagctgatgttccatcctccaggtgtggacactgaggtcccaatagggaaaatgatctgccagcttgaatcagatgggaggactgagcaaggccaaaaaatggggataataatatgagcccctcccttgatgggctgttacagaagaactgcaaggatccaatgggtgtctgcaacaagtgctctagaagtgggccctgctgttctctccataactcccaacatgttcgcaatcaaggagcctttttttttttttttttttttttgagacagcgtctcactctgtcacccaggctggagtgcaatggcgagatctcggctcactgcaagctccacctcctgggtttatgccattctcctgcctcagccttctgcgtagctgggactacaggcgcccgccaccatgcccagctaattttttatatttttagtagaaatggggttttgccatgttggccaggctggtctcgaactcctggcctcatgatccacccacctttgcctcccaaagtgctgggattataggcgtgagccactgcaccccgccaatcaaagagctttgctattgccataggattcacatcagggtacagtgggtccccagcccaagggcagagggagcccagagcatttaataaaaagactgcaaaggggaggcgccaatcatgggccccagctccagtaagacgtgaaggaggcaggggtgggggtaggagggcttgtacagcacctcagtgcttccagcttctgacggggagtagctgagcattttccctgggctgggggcatcagtagtgggggccaggcctcaccctcctcagaaggtaggtgggctctccacagcctgtctccctcactgacacatgcacactcactggattctcaccggcacttttgtgatagctgtcatcatcattcacacctatttcttttcttttctttttcttctcttttttttgagacagggtctcgctctgtctcccaggctgaagtgcagtggcaccatcacacctcactgcagcctcaacctcctgggctcaagcgatcctcccgcctcagcctcctgagtagctgggactacgggagtgcaccaccacacacacttcccctaactttttttattttttggagagacggggtctagttttgttgtccaggctagtctcaaactcctggactcaaatgatcctcccgcctcagcctcacaaagtgctgggattacaggcgtgagccaacctcctgggccactcacacctatttcttagaagggtaagttgaggctgactgcagctgactccttccccaaccactctcacaccctactggctgactcaccctgcttggcagactcctgggcccctcctctcggactctgcgacaggccaagggggtccagaccctccctgaccccaacagtcccaagacgccacagctggtgggcggagaaacaaggggattctcccctggggccagtggccatggcttggcctcgagtgaaccctgctagggccccaaacccagggcctacctagctcctgttcttcccgcgcgggggaaggggggtgctctgctcccctccctcccctttctggcagggctcacggttcttccccggggcgcatccacaaacctgagctccttggcgctcaccaccataacgctggcgtacaaagctgcttccattcactgagcactcagtaggcgccgggcacagcactaggtgcctatccggcgtagacatcgggcctgatcatacagctgagcttcagagacctcaagtccctgcccaggcccacacagcgctcagcggtgctaggatgcccacttgacagacagcgaaactgagacccagaggggtcaagtcaggggcagaagcagactctggaggcctccgggttctggaccttctctgccccattgtccctgattagcccgcaagcaagccacggcctaagccgaaggaagaactcgcctgcaggagcccccgttcgttcccagggtttggacgccccgggctgggccccgctaagcccctcgggccgcccaggcgccggacccccgtccccggagcccccgcgcgcgctcactttgggcttgtcgaaggcgggcgtctgggccatggtgccctcgtgcgccccggcgctgctccctccgccgccgctcggtgggtctctgccggctcggtggccgctcggctttccctggggccagcggtggccgcggccggccacgctcttcttaacgggccgggccccgcctcccgccccgcccgccgccgttcccggggcccgccctctcgccggagcccccgccccgcccgccggcctggatcgcgcatttcctggaattctggacccggcgtcctcgcccgccgacccgaaaactacggccccgcggcgcccgaccggacccacctgtgggcgcgcgctccagccgcctcgctgggcgctgccttccccccggctcctccagcaactttcaagcgtccccctgcagtctgggcgctgctgtgcgccaggcccaagctagaagcggggaccccgggagcatcgcaagcctcgagcggcgtgccttccaccggatagacggacgctcgtcgcagaaacacacaccataattgtatagttaaggaactttcgaggggggccagccgtggcctgcagaacctgcaggagttcatcaggggtgggtgggggtggagaggacattctacgtgagagactccagggagctgggagtgaaaggaggcgaggaaggctggagctcggagggagggagaacacagacagtcccctcctgggcattcacctttaagaaacccgcccaggcgcagccagagacctgtgcagaatgttcacaccagcgctattccgaataacaggaacattggaaacaccctcaaatgcccctccacgggcgagtgggcaaataaaccggaatattcacaccatgaaacgttagacagcagtgaaacggaatgaacttcagccagacaacaacagaaacaatgtctcagaaacaatgttgagtgaaaaaaactaagttgcggaaaactgcatacaatggtgcaacttttagaatgtgtaaaagcaaaaccaaaagtatgtatgtttagacacatgcatcggtggaaaaaatgtaaagcaagggaaagatgagcatagatacgagaagagtggttatctcaggtgaaagggaaggagccgggaggaggtaaggacggagggaaataacacgcgggtacaggttatttatttatttatttatttatttatttatttatttatttatttactgagacggagtttcgctctttcgcggaggctgcagtgaagtggcgcgatctgggctcactgcaacctctgcccctctggcccgcctcctccccaccgctcccccgcacccccagcgtttcaagcgattttcctgtctcagcctcccgagtagctgggattataggcgcccacaaccacgcctggctaatttttgttttttgtttttttgtttttgtttttgtttttttgagatggactcttgctctgtcgcccaggctggagtgcagtggcgaaatctcggctcactgcaacctccacctcctggattttaagcagttctcggcctcagcgtcccgagtagctgggattacaggcgcgtggcaccgtgccctgctaagttttggatttgtagtagagacggggtttcaccatgttggccaggctggtctcgaacacctgacctcacatgatccacccacctcggcttcccaaggcgtgattacaggcatgagccaccacgcctggccacacacaggttattgataatgttccagtactggggtggatggtagcttcatttcatttcatcataaataaattaacaaacccataaacaagggggaaagagagagtgggagagtggagagcaaggggctagaaggtctgatgggagctgaatcctgccagggatgtgggacccagcgatggtgtgggattcctaggaagtcagtggagtgttttaagtggaggcgagacaaaatcacccttttatttggaaaaaatattctccagctactgaaagtgtgatccagggatcatcagcacccacatcacctgggagctgactacaaatgcagactttcagaccccatcccagacctactgaagtagaatctgtattttatacaaacaggacccccaggtggttcgcacccacagggcactttgagaagcctgggctccctgctgtgaggggagggcattacagggggccagcgggggtgagggaggacaggataccaggaaggaggcaactgccatggtctgggtagggcatagtgatgtcagtgggggaagtggagaaactcatattcaagctgcatttagggtgtaaaatcagctggatttggggtttggttgtatgtgggagtgagggagagggtggctgtattagtccattattttcatgctactgatgaagacatacccgagcctgggcgcagtggttcatgcctgtaatcccaggactttgggaggccaaggcaggaggatcacctgaggtcgggagtttgagaccagcctgaccaacatggtgaaaccccgtctctactaaaaaaaaaaaaaaaaatacaaaattagccaggcgtggtggtgtatgactgtaatcccagctactcgggaggctgaggcaggagaatcgcttgaacctgggaggtggaggttgtggtgagccaagattacaccattgcattccagcctgggcaacaagagcgaaactccatctcatgaaaaaaaaaaaaaagacatacctgagactgggtaatttacaaaagaaagaggctttaatagacttacagttccacaatggtggggaggccttgcaatcatggcagaaggcaaaggaggagcaagtcacgtcttacatggatggcagtagacaaagagagagcgcctgcagggaaactcccatttttaaaaccatcagatcttgtgagacttatttactatcacaagaacagcatgggaaagaccatcccccatgattcaattatctcccgccgagtctctcccacaacatgtaggaattatgggagctactagatgagatttgggtgaggacacaaagccaaaccctatcagtgggtctcatacattgtcaaagccaggggagttttttgtaagatcctttcttggctctctgtgttactcgggttcaataataggggctgccatttactgagacaggtttggagccaggtacactgggaagcactttataagcacccatcccatttcatctttacagtcatcctcagatgtaggaggtgttctcctcattttacagatgaggacactgaggttcagatagagagacagcctgcttggctcatgggttgtaagtggcaaaactggggtttaaatttgaatctgactcgagaaacttcactccccaccttattgcctccccagcctctcatgacattcaagtccctcttcaacatcagtcccaccacttcccaccacattgctgaaatgccaatcaacctagatgagttgctggttgcttaagggtgacacaaattatttgcaattcttcacattgcaagatggagtctaggtttcctcctcttggacctgggctggcctgagtgacttgttggagtaatagagcgtgatgggagcaagcttcctggatttccgagccttggtcataaagaagctttgtggtgtcctttggggcctcttgaacattctctctgggaacccaagcttctagaagagaccatcatgctaagagagtccacatatggccattccagttgacagtcccactgagcccaggcttccaccatccctacgaagacagcaatcatgttagcgaagctgtgttgggccatccagcccagctgcccactgaaaaccaggctttggtcaatgccatgtgggacagaagaattacccaagtaagcccagcccaaattcctgacctatagtattgagatatgtaatgaaatggatgttattttaagccattgtgttttagggggagattgtcacacagcagtaggtaacaggaatgcttgcttctacctgccccagccctccagcctctgcaccttagtcacttccatcctgacacctggaaaaccctttacccagatcctagactatcaaaattctgcattccaaatgggtcagatccaaagggccaggctgcgtgatgcagttcttctgtttgcccctgcaggtgcactctccacccttctgcacgctgctctgctcctctgtgtccggcagccatgctgctgtgggtgagaccaatgggctctcctgccctctggctctggttgggttttgtcaacagggagcaccagcaggagaacagcagatgagaggagagaggtcaggatattcattccccctttccctcggtgcacagtcactgggctgactgtgtctctctaccaaggccacatctcctgtcagtcctcctggcccacctctccataccctccccattccagattccctcttgcctattgattgattgattgattttgagacagagtctcactctgtcgcccagggtggagtgcagtggtgcaatcccagctcactgcaacctccacctcctgggctcaagcaattctcatgcctcagcctctggagtagctggaattacaggcacccaccactatgcccggctaatttttgtatttttagtagaaacttggttttaccatgttggccaggctggtcttgaactcctgacctcaaataatccacccaccttggcctcccaaagtgttggcgttacaggcatgagctaccgtgcctggcctcctgccgttttcttgaaaggcagtggttccctttgttaccagagtcccacgccacccgttgttgctttccttaaactctcctcgctaggttcaggtttccccagaagcagagcctgagacaaagatttcaatgcaagtagtttatttgggaagaggaaacatgggaaggatgtgggtgcgaaacaagacaggaaaggggaagaagctgacatgagcaggtcaccacactgagcacctggagctctatccctgggcagcactctgggagatgatgaatatgttgcaggcttaacccagcagaggagcgaggaagctggggaatctaactgccccctcccctctggcaatgcttccaggacattaacttcctggcactcttagtttgttcaacatgaccggctgagtttcttgcatggctagaaaatatttgcagcaatgagagagagactctgttagcagtaagtagctattgccatgtagaggtgattttgagggcatatgggcagctacaccagcccacacctatgtaaataactcccatattaaaccctcttcaattactcagtttgagtgtggcacctggttcctgccaggaccccgagtgatacaggctggtcttgagcttcttcatagcaatacagagtggaccagtgactacagaaagcttgagaggggctggagagagatgccttccccaatattcattatccacacagcacgccactcctgtgagaagacaacagagattgtgtatgtttgagaatgtctctctacctccaatgtagccctcctgaaaaatctagttcaagatctattccaggccaggcgcagtggctcacacctgtcatcccaggactttgggaggccgaggcgggcggatcacctgaggtcaggagtttgagaccagcctggccaacatggtgaaaccccatctctactaaaaatacaaaaattagccgggcatggtggcatgcacccgtaatcccagctactcgggaggctgaggcatgagaatccctctgggccacagagggagactctgtctcaaataaataaataaaaatcaagatcaaaatgtatatgatcaggagcctcagctccaccacttacagctctgtggctttgggaaagttgttttgagccttgattttctcatctgtgtagtggggataacatatacatactaattaataggataaaccatagacacgcctcgctcataggaggagaagaacatcctcacacaatgggagaggtggggattgtggaaaggagagagcaaatgcctcgtcaagatgctgctgtgctgaaacataaatccagtgttgccagatcctccaatcatccaaaaaagccggagacccatcttttaatgtttaaactgtattcaaatgtgtcctaatgtttaaaactttgtataagccaaagaaaacatctgtgggccagattttgccccacacagccaaggtccctgctgattctgatcttctaagatctctgaataagaaagaggacaagggacaggttgccctttcactcacatttatcagacaggattaggatcagttgcacacaacagaaaacacccaaataatagtggctgaaaaaagacagaagtttatttctctgttgtgtaaaaaggccagaggcaggcaatgccactgatgtgacaactctgtgaagatgcctccttctatctctctgctctgccatccctagcatccagcccctatcctcattgtgcagtatggctgctggggcaccagccttcacatctgcagtccagagagcagggctgaggaaaggatgcagcagctagtgcttgtctctctttttttttttcttgagacagagtctcactcttttgcccaggctggactgcagtggcactatcttggctcactgcaagctctgcctccggggctcacgccattctcctgcctcagcctcccaagtagctgggactacaggcgcctgccaccacgcctggccacttctgtcttttaaagatctagatacctggttttcctcacaacaaattctgcttatatagtcacatggccacatctaatcgcaaaggaaactaggaaatgtcttatacctgtaaggcaaggtacccagctaaaaaaaaggagattgtgttactaaagaagaggatagtaggcccactgcagtggctcatgcctgtaatcccaacactttaggaggtcgaggtgttcgatcacaaggtcaggagttcgagaccagcctcacgaacatggtgaaaccccgtttctactaaaaatacaaaaattagctgggcacggtggtgcacacctgtaatcccagctaattgggaggctgaggcaggagaattgcttgtacctgggaggcagaggttgcagtgagccatgattgtgccactgcattccagcctgggtggacagagcaagactccgtattgggggaaaaaaaaaattagaggatagtagatctagaaggctgctcatttctgccacatcaaatagcctggtaggtgaggagggtatatggataggtggaaagagtgttaccaggaagccagattctgctgtccatatcatatgtctttaagcctctttctgaccaggagaagaaaataagagagcaagatagaaagaggcctgagtataatcatagagacaacttaccaaggacctgttgcatgccaggcccagcactgagtcttgtgccaacattgttttagtccattttgtgctgctatagcagaatacctggaactgggtaatttttatggaacagaaatgtattggctcatggttctggaggctggaaagtccaatatcaaggtgctggcatcattcaagggccttcttgctgcatcattccatggtagaagatgagagagtccgagagggtaagagagggagcaagagattgatctcacggcctcaagcctttttatactcagcattaatccacccatgagtgtggagcccccatgacctaaacacctcccatgaggccccacctgccaacactgttgcattggggattaagtttctaacacatgcttgttggggaaccacattcaaaccatagcaaacatcatctcagattattcttttcatccagcctatccggtgggtgggcctcgtgttattgtggggtggggtcacatcttgcctgtgccagctggggtaggaggcctggacatccaattgtctcccagattgataaccaacccacccttctgtcttctgccctacctgacaccacttggtcttcagagatttctggtccctccaatccctgagcctgagattctgcaatttgctttgtcctaaaggctccccgtgagcagccaggtttcaacttcctgggtttcttgtcagtccccactcaccatctgccttccagcttccggaatttggttgattcttctcatctgctattttcttcctcatacgttttctttgtcccagtagatagatgtgcatttaaaaaaaaaatccctgtgtcattttcttggaatttcagagaacaatggagagaaataagtgtgttcaacctgccatgtttaaacagcagtctccagcctcagttcttgactgggggaatcctcagccctcaggaggattgtatggtatccccatccttcccccattccttccttatcctgctccaggagtccatgggagccctcggcacacaggactctcttccccactctctgaacctggggcatagttctgtcctgcctccatagcccatacctgcttctcaagagcaggggccttgtcttcttctctctacttcgacaggtctgggcaggcctcaggaagatagatatgagctcatggtgtgggtcattcctaagaagtcactttggactttgaggagttaaaattcaaagctggggatgagagtcaggcatttctaaattagaatatcaagtgtattcccactgtatttacaatggaggccagcatcaacactcaaggtgaaagcctgatagagtcacattggtccttgaaaacctcttaggaagatgccaggtggagacagaggcatcgtccctcactgaatctgatacagccagcattttctccggggcttcttccccatgtcttgagtaagtgcctgctggagatcctggtttgggttgagaagctgtgttatgtagacaaagtgcatcttcagatcctagaatcttcctcagtgggtcatgagcctcatgttgctcataggaaaagaggccaagaactagggtgaccaaccatcctggtttaccaggtctgagtagtttattgaaatacagagttttcagtgctaaaaccaaaacagtcccagggaaattcccaattgtggtcaccctacagaacaaccgtaacaacaggattacctctcacacaccctcctggacatgtgcatgttacacaatttgtccactttctgttgctgtcatagaacccatgggactgggtaattgacaaagaaaaggggtttgttttttacagttctggaggctgggaagtccaagacagggtggctggatctggtcagcttctggtgagggcctcgtgctgtgttgtaacacagcagaatgcatcgtagggtgagaggaagcaagagaaagccgaggaagcaagagaaagccgaggaagccaaactcacttttgtaatgaactgctctcaataactcacccacttctgtgagaattaacccactcctgtgagaaaggcattaatccctcctaatgacctaatcccctcttaaaggccccacctcccaataccattacattggggaccaagtttctacatgcattttggaggagacaaaccacatccaaaccatagcacacacacaacataaaatcgttatctcctacagtttaccacacccctcaacctccacgcccctctcaccagccttttttttaatacgaattcttgctgttgttggcctgggctggagtgcaatgacacggattcggctcactgcaacctctgcctcctgggttccagcagttctcctgcctcagcctcccgagtagctgagattacaggtgcccgccaccacgcccacctaatttttgtatttttaatagagatggggtttcaccatgttggcagggtggtctcaaacttctgacctcaggtgatccacccacctcagcctcccaaagtgctgggattacaggtgtgagccactgcgcccggcctcaccagcccttttaagggaaatagatggtagacttgttcggagagtgggctctggaactaggctctggaagcttcagttgcagcattcattagctgtatgtgtttgggcaagtcactttacctctctctgcctcagtttccttatctataaaattggaagaataatagtaagttctactctgtcaggtcattgtaaggattgaatgaattaatattatggagagcagttagaacagtgcctgtcatggaggaagctacacaggtcacaactccttaactgaaactccagtgtctcaggatcctgatgcattttggaatttagggagttttgggattttggaaagcacatgacttatataacacactagtgggtagtgggatctggcttagcatcccataacgaaacacattaatatttctgcagaaaacaatatacgagtattcatacatctgttcaggttaggttttggctacccaatgagttttggtgttacattattttgttcagaaacactgggatctctgaagtgtggataagggcttgtaggtctgtgtaaggttttgctattattattgttgaatgtgcatctgatataactgccatgcagttgcttcttgaggacaactctgagcttttatgcccaaggccctcctggactcttggagttttctagcagggccttcctgcaccaagagctctgaataacctttgaaggctgacaggacactctcttcttctctctctacctaggtcctcaatttagtgatgtctccctgttcctctcagtgtggtaatagaggttggcaggggaggggtaggttgcaaatgcaatctccaggagccttccccagcctgaccctcaccccctcaaccccagctggtcccagtgggggaggggcacaggttgtgtggaagtgatgagtaagcccctcttctggtgaagctattgtgggttcaggcaatcgtctggcctgcacaggcaagataatggagtcaaaggaggcttatggcccctcagccgcccctgggcatgcacagatgtctctatggcacacactagcacttgcagaaaagcattggtgccaggtgcggtggctcatgcctgtaattccagcactttgggaggccaaggcgggtggatcacttgaggttaaaagttcgagaccagcctggtcaacatgcaaaaccccgtctctactaaaaatacaaaaattagccggatgtggtgacgggcacctgtaatcccaactactcgggaggctgaagcaggagaatcacttgaatctgggaggtggaggttgcagtgagccgagatcgcgccactgcactccagcctgggcgacagagtgagactctgtctcaaaaaaaagaaaagaaaagtgttggaggggaacgagaaagttcccccttaattctcagccagtatttactgagtgtgaccctgggctgggccccaggctaggtgctggggacacacagtgaggaaaacctggcccctctgagataaacccacaggccaggggcagctgccttctgacattgggggtatggggctggccctcaccctgaccatggtggcaggtgcccacccacccttcaaagcaagaggagggagggagaagtgcctgtatgttcaagagttactttacaaggacaaatgggtccatcaccttggttgacgtcagcaaagaagcatcagccaaagccttgaggtgaccccaaaagactggggtgcaggttagggggttgagacaggctcagcatggagagaggagggtaaagctcctgcagaggccccagctcccaaagatgaagctaccgcttgatgatgctgtctccagggccagagatcttcctctcatcccgcactatctgcagtcctctctggtgtgtgtggggcgcagtcattagacccatcttccaggtgagagatctctgcctcagggctcagaggacctcctcctggggtttcagatcagtcttccaggatggaggatgggaagcaggccatcaagagttctggtaagaaatgaggtttctagtcaggtacggtggctgacgcctgtaatccaagtactttgggaggccgaggcaggaggatcacttgaggtcaggagttccagaccagcctggccaacatggtgaaatcccatctctactcaaaatacaaaaattagccaggagtggtgaagtgcacctgtagtcccagctatttgggaggctgaggcagcagaatcgcttgaacccagaaggcggaggttgcagtcaactgagatcgcacactgcagtctagcctgggtgacagagggagactctgtctcaaaaaaaaaaaaaaagaaagaaagaaagaaatgaggtttccctgactgagtctgggaagctggcattcattcgttctttcactcattcattctggctgatcccgagctctgacagttcctatctgcatgaccctggcagctcacctcagccctgagcctaagattctactatgtaccaggcactcttcagtctacttaggatacagaaggagccaggtagtcatgacctccagcctcatgacgcagataatggggtgggggtaggggcaactagcttattctggaggcttcctgtaaaaaacaacgcttaagtggaggtggacagaatctccccatcacgctggggaaaggcagaaatggatttagcaaacttactgtgaaagtcacagcttaagccttagagcccctcacttgccaggggccttccaggggcctgggaggggccaagtaatgcacactcaggatcacatgctttagtagaatttgccaatgtaagatgttttaactgtaatttattaagactgctgcccctctcactccaacttccctctctgtcatacttccccttcttttgggtattgccccagtgcttctggcattttgggggatctagctaaggagaagttgtcacggaatactgacattgatgaaaataacaaaagtcaaaatacaccactacaaaaaggatgtaatagaaagcatcaattcaaaaaaattttaagattagtcatcaaggaaacataataagtccggaaatcttacagctccgatatgaaagaaacttgatagaggttcttccaaatttgacaacaatcctagaattttatgaccttccagtagtccccccttatcctcgagggatacatttcaagaccctcagtgggtgcctgaaaccgtggatagtacggaatcctatttagactatgttttttttgatccaatagccaagacaactactaagttgacgaatgggcaggtagtgaagatgctggacaaaggggcaattcacacccctggtgggacagggtggggtagagtggggcagcaccaaatttcattacgctactcggaacagcatgcaatgtagaacttaatgaattgttgatttctggaatttttcatttaatattgtcagactgtggttgtccatgggcaactgaaacctcaggaagcaaaaccttgcagaagagggggctactgtaccagtaataagttgcaaagctgaaagaaactttatcgaccataagaaatttggggccaggcacagtggctcatgcctgtaatccccgtattttgggaggccaaggtgggagggtggcttgaggccaggagttcaagaccaatctgggcaacatagtgagactccatctctacaaaatcttaaagtattagttgcatgtggagacacatgcctgtagtcctgattacttgggaggctgagacggggagatcctttgagcccaagagtttgaggctgcagtgtacaaagatcagacaactgcatgcctgcctgggcaatggagcaagaccctgccttaaaaaaaaaaaaaatgggggccgggcacggtggctcacacctgtaatcccagcactttgagaggccaaggtgggtgaatcatttgagaccaggagtttgagaccagcttggccaacatggtgaaaccctatctctactaaaattacaaaaattcgccaggcgtgcctgtagtcctagctactcaggaggctgaggcaggagaatcgcttgaacccaggaggtggaggttgcagtgagcctagattgcaccactacactccagcctgggcgacagagcaagactctgtctcaaaaaaaaaaaaaaaaaagaaaaaaaaattagtcaactgtgctagagaaaagattaaagtatcttcttattctctctaaagaaaatgacattacaaaatcaatgtcacatgaagaggttaacgtaaaagtatacaaacacaatgtaggaatgaaataattatagatatgtatcatattgatgaaaatatgaatgtaaatgtaaattttaatttatgtaattatgaacaaaaatgtaatgctattatgtaaataaatatatttattatgttacatgtaacttaacatgtttaataacttattatgttatgaactgttgctgactatgtggccacaacaggggagggaatcttgggacccttattcagagagatcaagaccaaataaaggacctaataagtcatttccttcaacctgtcaccagtgcaggaatcctcttcctgatgacagctgtccactgagcctcggctctgtacatttcctgggatgaggaattcacccctcctccaaatcctgtactatcttgggtcaaaactctggttgtgggaagttctttagtcaagctgatcactagctgtcggtggtttccccttgggtcctcatcttccccagcacccccagaaatcatgggctgctgcttcccattttattatagctctgcagtgctacaatgcagctctagtatcttgccctggcctgggataacctgcccttcttcaaagtttccttttatgtcttgacttccaaagtcttcctcatccatgatcgcagagattgatcagccactcatacatatatgaggacgacaatgatgatgatgataatgagaacagctagccagcactgagtgcttactgtgtactgggctccgtgctgggtgctgtatgagcacctgctgttggtctcatgcacacctatttatgttggttttgagtaacttgtgcaggtatacctttgatttaaaattttggtttctatttagactacgataggaatttttgttttgtttagccttctctcctaagcttaatgaaaccacatattcagaaagaaaggacacatttaattaaaacatttcaaagacacacagcttaaaagagtgattaccctagacctcttacaaacaaatatgcccctcctccaaaactcttcttaatgtaaatttcagagaggaaaagccaaaaacaaaaacaaaatcgagaatgtgtgttaatttatctggctaaaacctgataaaaagattttcttggccgggcgcggtggctcacgcctgtaatcccagcactttgggaggccgaggcgagcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaagattttcttaagagctctgtagttcaaagtcaacttaattaaaagcaggtattaagactataatttttaaaatagagcctttctgcttcttctattttggatcttgttttggggaattttttttcaggtgactgaaacccctcttttaattatatggtgagtccctctctctgttcgcttcctttcttgttggtgtgattttttgctgaaggaaaaaaaaaatgtaaaacttaagcagctttctggaaagcttaaatttattctctgtgctttgaaatgtaaatttcctaccttgtctaaaattcagtgaggtactcgcttcgcagcacatatactaaaactggaatgaaggccgggtgcagtgactcacgcctgtaattccagcactttgggagtctgaggcgggtggatcacctgaggtcaggagttcgagaccagcctggccaacatggtgaaaccccatccatactaaacataaaaaaattagctgggcgtggtggcacatgcctgtaatcctggctacttgggaggctgaggcaggggaattgcttgaatctgggaggtggacgttgcagtgagccaagactgcaccactgcactccagcctgggtgacagagagagactctgtctcaaaataaataaataaacaaataaataaataaaatgaaattggaatgatagagaaaagattagtagcatgtcacctgtgcaaggatgaaatgtaaattctgaagcgttccattaaaaaaaatatgttatttaataaaattaattaaggccaggtgtgatggctcacacctgtaatcccaacactgggaagctgaggtcaggaattcaagagcagcctggccaacacggtgaacctagtctctattgaaaatgcaaaaattagctgggcatggtggtacacgcctgtaagcccagctactttggaggctgaggcaggagaatagcttgaatccaggaggtgggaggctgcagtgagccgagattgtgccactgaactccagcttgggcaacagagcaagactctgtctcaaaaacaaacaaacaaaaaaatgaaaaaaaaataagtcacaaagggatcaaacttcattttggctactcctgctttggcgatggccacaaaagggaaaaagtttttcaaatttttttggtaactatgcctttagagttttgccaagctaaattaaactatgaatatttattgaagatctagatcatttccaaataagatataatgctaagacattaattactacatataagtttaagctcatatacttttggtttcttatttcagagaaacaaaagatatttaggggctgggtgtggtggctcatacctgtaatcccagcactttggaaagctgagataagaggactgcttgaggccaggagttacagaccagccagggcaacatagtgagaccttgtctctacaaaataaaaattttaaagttagccaggagtggtgttgcatgcttgttagtcctaactactcaagaggctgaggcaggaggatcgatcactcaagcctaggagtttgaggctgcagtgagctataatcacaccactatattccagcttgggcaacagagcaagaccctgtctcaaaaaaaaaaaaaaaagagatattaagatccgctagtaaaagtatcctattccacactgaaaaattgttccattagaaagcctgtgtttctaaatattataaaatgtgtattaatcaattgttagtacatagtgacaaaattacttctggctgggcggtggctcacacctgtaatcctagcactctgggaggctgaggtgggcagatcacctgaggttaggagtttgagaccagactggccaacatggtgaaaccctgtctctactaaaaatacaaaaaattagccaggcgtggtggtgtgtgcctgtagtcccagctacttgggaggctgaggcagaagaatcacttgaacctgggaggtggaggttgcagtgagctgagatcgcgccactgcactgcagcctgggtgacagagtgagactctaaaaaaaaaaaaaaaattacttcttagattttcagtataaattaagattactaagatttaaaattctgactaatatatggtaactaacactagagaccagaaggaagacaattctgtattcagaatatgtaaggaaagtaagacatctttttaggaaggaagattataagaaagacataagcatgtggtttttgttaaagagaaagtggttttgcctagtttagaggttatttaaaggctgtatgaaattgggataaaagaaggaaagaataaaatagattaactgaatggatatagaaagttgggaaaagaaagaggaatggaaaaattgtaagaagttataaaaggtttatagaaatattatctcgtgtggtcaaagctgattgagattagatgatttataaggttttattaaaattaggctttatatttataatgcattgatgcaaaagtagaatcatttttctattttgaactagatagtcacatagttttttttttgttcttttttttttttttttttgagatggagtctcgttctgtcacctaggctggagtgcagtggcgtgatctcggctcactgtgacctccacctcctggattcaagtgattctcctgcctcagcctcctgagtggctgggattattggcatgcgcctccatgccaggctaatttttgtattttgagtagagaaaaggttttgccatgttaaccaggctagtcttgaactcctgatctcagggtgatccgcctgccttggccttccaaagtgctgggattgcaagcgggagccaccgcaccctgcctcatatagtattaataagagatagcaaaagatttttttgtttaccttttgagtaaactgctgctaaaaaaaaaaaaaaggagaaaagaaacgggggagagggagagacattctgttggtctcaagttgtctttttcaggtcttttgtgtcaggcctctgagcccaagctaagccgtcatatcccctgtgacctgcatgtatacatccagatggcctgaagcaactgaagatccacaaaagaagtgaaaatagccttaactgatgacctttcaccattgtgatttgtttctgccccaccctaactgatcaatgtactttataatctccccccacttaagaaagttctttgtaatctcccccacccttaagaaagttctttgtaattctccccacccttgagaatgtactttgtgagatccacccgctgcccacaaaacattgctcctaactccactgcctatcccaaaacctgtaagaactaatgataatcccaccaccctttgctgactctcttttcggactcagcccgcctgcatccaggtgaaataaacagccttgttgctcacacaaagcctgtttggtggtctcttcacacagatgcgtgtgacatttggtgctgaagacccgggtcagagggactccttcgggagaccagtcccctgtcctcaccctcactccgtgaagagatccacttacgacctcgggtcctcagatcaaccagcccaaggaacatctcaccaatttcaaattgggtaagtggtcttttcactctcttctccagcctctcttgctacccttcaatctctctgtccttccaattccagttctttttcctctccagtagagacaaaggagacacattttatccgtgaacccaaaactccagggccggtcacagactcaggaagacagtcttcccttgccatttaatcactgcggggacgcctgcctgattattcacccacattccattggtgtccgatcaccgcagggacgcctgctttggtcattcacccacattcccttggtggcaagtcaattgcggggacgcctgctttggctgctcacccacattgcagcccagggctgctccccacccccttctccatatctctacccttctctttaaacttgcctccttcactatgggcaaacttccaccctccattcctccttcttctcccttagcctatgttctcaagaacttaaaacctcttcaactctcacctgacctaaaatctaagcatcttattttcttctgcaacaccacttggccccaatacaaactaacaatggttctaaatggccagaaaatggcacttttcatttctccgtcctacaagacctagataatttttgttgaaaaatgggcaaatggtctgaggtgtcttacgtccaggcatttttcacacttcgttccctccctagtctctgttcccaatgcgactcgtcccaaatcctccttctttccctcccacctgtcccttcagtcccaaccccaagcgtcgctgagtcttgtgaatcttccttttctactgaaccatctgacgtctcaccttcttcccagactgctcctcctcagctcgctccccaccaggctgaatcagcctccaactcttcttcagcctctgctcccacatcctataacccttctattacccgccctccccacacccagtctggttttcagtttcgttctgcggctagctctcccccacctgcccaacaatttcctcttagagaggtggctggagctgaaggcatagtcagggtacatgtgcctttttctctatcagacctttcccaaatcagccagcatttaggctctttctcatcagaccccactaaatatatacaggaatcccgatatctaactctgtcctacagtttaacctggagtgactgaaatgtcatcctgacttctaccctctccccagatgaacgggaaagagttttttctctagcccaatctcacgctgataaccgccggcttcatgaacctgacctccaggaaggcagtagagcagttccccgagaggacccccaatggaactatcaggcagattccccaggtatggctaggcgagattacatggtttcctgcctagttgaagggcttaaaaaggcagcttacaaagctgttaattatgacaaacttagagaaactacccaaggtaaagacgaaaacccagctcagttcatggcccgctcggcagcaacccttacacactttaccgccctagacccagaggggccagaaggccgccttattcttaatatgcattttatcacccagctcctgacattagaaaaaagctttaaaaattggaatccggccctcaaaccccacaacacgaattaatcaacctccccttcaaagtgtacaataatacagaggaggtagccaggcagcaacgcatttctgagttacagctgctcgcctccgctgtaagacagcccacaaccacgtctccagcatacaagaacttcagaacatccaagccacagctcccaggggctccttcaaaacatcctcgtggaccttgcttcaaatgctaaaagcctggccactgggcctcagaatgcccgcagcccgggattcctcctaagccgtgccctgtctgtgcgggcccccgctggaggtcggactgtccgactcacatcactgccactcctaaagcccctggagcccaaaccctatgttccttggccgactccttcccagatctcctcggcttagcagctgaagactgacgtagcccgatcgcctcagaagcctcctggaccatcacagacgctgagcttcgggtaactcttaaagtggagggtaagtccatcccgtttaatcgatatgggggctacccactccacattatcttcttttcaagggcctgtttccctcgcccccataactgttgtgggtattgatggccaagcttcaaaaccccttaaaactcccccactctggtgccaacttggacaacgttcttttatgcactctttttcagttatccccacctgcccagcttccttattaggctgagacattttaaccaaattatctgcttccctgattattcctgtactacagccacatctcattgcccccttcttcccaacccaaagcctcctttgggtcttcctctcatatcccccgaccttaacccacaaatatgggacacctccactccctccctggcaaccaatcacatgcccattactatcccattaaaacctaatcacgcttaccccactcaatgccagtatcacatcccacaacaggctttaaggggattaaatcctgttatcacttgcctgctacagcatgggcttctaaaacctataaactctccttacaattctcccattttacctgttcaaaaaccggacaagtcttacaggttagttcaggatctgtgccttatcaaccaaattgttttgcctatccaccctgtggtgcccaacccgtacgctcttttgtcctcaatatcttcctccacaactcactattccattcttgatctttaaaatgctttttttcactattctcctacaccccttgtcccagcctctctttgcttttacctggaccgatcctgacacccatcagtcccagcagcttacctgggctgtactgccgcaaggcttcagggccagccctcattacttcagccaagctctttcttatgatttactttctttccacccctctgcttcttgccttattcaatatattgatgaccttctactttgtagcccctcctttgaatcttctcaacaagacaccctcctgctccttcaacatttattctccaagggatattgggtatccctgtccaaagctcaaatttcttctccatccattacctacctcagcataattcttcataacaacacatgcgctctccctgcggatcgtgtccgactgatctctcaaaccccaggcccttctacaaaacaacaactcctttacttcctgggcgtggttggatacttttgtctttggatacctggttttgccatcctaacaaaaccattgtataaactcacaaaaggaaacctagctgactccatagattctcaatcctttccccactcctctttctgttccttgaagacagttttagagactgctcccacactagctctccctggctcatctcaacccttttcattacacgcagccgaagtgtagggctgtgcagttggaattcgtacacaaggactgggaccgcaccctataggctttttgtccaaacaacttgaccttactgttttaggctggctatcatgtctccatgcggtggccgctgctgccctaatacttttggaggccctcaaaatcacaaactatgctcaactcactctctacagttcttataacttccaaaatctattttcttcctcacacctgacacatatactgtctgctccccggctccttcagctgtactcactctttgttgagtctcccacagttaccattgttcctggcccggacttcaatccagcctcccacattattcctgataccacacgtgacccccatgactgtatctctatgatacacctgacattcactctatttccccacatttccttctttcctgttcctcaccctgatcacacctggtatattgatggcagttccactaggcctaatcgccacacaccagcaaaggcaggctatgctatagtatcttccacatctatcattgaggctaccactctgcccacctccactacctctcagcaagctgaactcattgccttaactcgagccctcactcttgcaaaggaactacgcactacgcatcaatatttatactgactctaaatatgccttccatatcctgcaccaccatggtgttaaatgggctgaaagaggtttcctcactacgcaagggtcctccatcattattgcctctttaataaaaactcttctcaaggccgctttacttccaaaggaaactggagtcatacactgcaagggccaccaaaaggcatcagatcccatcgttcagggcaacgcttatgctgataaggtagctaaagaaagagctagcattccaacttctgtccctcacagacagtttttctcctcctcatgggtcactcccacctactctcctgctgaaacttccacctatcaatatcttcccacacaaggcaaatggttcttggaccaagaaaaatatctccttccagcctcacaggcccattctattctgtcatcatttcataacctcttccatgtaggttacaagccgctagcccgactcttagaacctctcatttcctttccatcatggaaatctatcctcaaggaaatcacttctcagtgttccatctgctattctactactcctcagggattgttcaggccccctcccttccctacacatccagcttggggatttgcccctgcccaggactggcaaattgactttactcacatgtcccgagtcaggaaactaaaatacctcttggtctaggtagacactttcactggatgggtagaggcctttcccacagggtctgagaaggccatcatggtcatttcttcccttctgtcagacataattcctcagtttggccttcccacctctatacagtctgataacggattggcctttattagtcaaatcacccaagccgtttctcaggctcttggtattcagtagaaacttcataccccttaccgtcctcaatcttcaggaaagatggaacggactaatggtcttttcaagacacacctcaccaagctcagcctccaacttaaaaaggaggactctgtcaaggatacagcccaaaaactcaacaaccaagcaagtaattacgctgaacagccttgggcactctctaattggatgtcctgggtcctcccacttcttagtcctttaatacctatttctctccttttattcagaccttgtgtctttcatttagtttctcaattcacacaaaaccgcatccaggccatcaccaataattctgtatgacaaatgctccttctaacaaccccacaataccaccccttaccccaaaatctttcttcagttgaatctctcccactgtaggttcccatgctgccccaatcccactcgaagcagccctgagaaacattgcccattatctctccataccagccccaaaatttttcgccactccaacacttcaccactattttgttttgcttttcttattaatataagaagacaggaatgtcaggcctctgagcccaagctaagccatcatatcccctgtgacctgcctgtatacatccagatggcctgaagcaactgaagatccacaaaagaagtgaaaatagccttaactgatgactttccaccattgtgatttgtttctgccccaccctaactgatcaatgtattttataatctcccccacccttaagaaggttctttgtaaccccccccccgacccttaagaaggttctttgtaattctccccacccttgagaatgtactttgtgagatccaacccctgcctgcaaaacattgctcctaactccaccgcctatcccaaaacctataagaactaataataaacccaccaccctttgctgactctcttttcggactcagcccgcctgcacccaggtgaaataaacagctttgttgctcacacaaagcctgtttggtggtctcttcacacagacgcacgtgacattttgattgtttggaaaattcagtctcctctctatgaaagagtaaaagtttgctttttgaaatatttgaatcatcactttggctagatgaatgactacaattttaaactcactttgccaacacactgacattggcagagtgcaaagatggcaagaggctgggtccatggtgacactgttagggaaacaggagcataacagagtcagggtgacaccattttaaaatcaattgtggctgggcacagtggctcatgcctgtaatcccagcactttgggaggctgaggtgggcggatcacctgaggtcaggagttcaaagccagcctggccaacatggagaaaccccatctctattaaaagtacaacaattagttgggcatgatggtgggcacctgtaatcccagctacttgagaggctgaggcaggagaattgcttgagcccgggaggcagagtttgcagtgagctgagatcgtgtcactgcactccagcttgggtgacagtgtgacactctgtctcaaaaaataaaataaaataataaaataataaaatcaactgcatcttcaaactagcaaggcacattccttggcagtcacaactcatggccatgatatgttttgggtgaaggaagcgatttagtaatgcctgcaagggcaaactcctatggtggcagggtgtccagatatcctaatagcacataacaatatctgcttttgagataggtaaagtcatgctttgaagtatttcctcactaaaataccaaggataattttatttaaatcaacaaagcactaaattttcttttttcttttttgagatgctcactctgtcgcccaggctggagtgcagtggcacgatctcggctcactgcaagctccacctcctgggttcacgccattctcctgcttcagcctcccaagtagctgggactataggcgcctgacaccatgcctggctaattttttgtatttttagtagagacggggtttcaccatgttagccaggatggtcttgatctcctgacctcgtgatccacccgccttggcctcccaaagtgctgggattacaggtgtgagccaccacacccggcctaaattttctttaaaaaaaaaaaattattgtatttatggctgggcactgtggctcatgcctgtaattttagcactttgggagactgaggcaggcggatcacttgaggccaggagtttgagaccagcctgggcaacatggcaaaatcccatccctaataaaaatacaaaaaaaaattagctgagcatggtggcacatgcctgtagtcccagctacttgggaggctgaggtgggaggatcacttgaacccgggaggcagaggttgcagtgagccaaggtcgtgccactactctccagcctgcacaacagaaaggactccatctccaaaaaaaaaaaaaaaaaaagtatttatttatttttcatttattccaggcagaagaaacagcaaatgcataggtcctgaggcaggcatgcatttggcatgttggaaaacatgtggcactggccagaccaagcaaggccttggagaacatgaagagcagtctggcttttgctccagttgccacagaagtcactggaagaggcctcctctgagataagacactaagaaagcagtgtcaggccagttagacaggtctggacttgtcttctggagtcaaatgcaggcggcagacatttaaatggccagtcacagagagggtgatgggggccatgatgggtgacccacagggccgtgagagcacagaggagggaccctgccccatcctgagggcccaagggtccttcccaggggaagagagagctcagctgagacctgaaggctgcagcagagttagccagcttgaaagagaacgacaagggatgggatgggaagtggattccaggcagaggaagaagcaactgcaaacgcctgagaagagaaagcctggagcatttgggggaccagaagggggttaatgtggctggattgtagatgcaaacaggggttggcctggggggcaggcggcagcggctaggagggctctgcttttctcacttgatatactgtgaacatttttctatgtcagaaaggatccttctgctataggatttttaagggctgagcattacgtcgtggaataactggttctccagtgtcagacatttaggttctttctagtttttccctcttagaaacaatgctatgttgaacatctttgtctgtgcatctttgtgcacacgtattattatttctgtgcggtaaagttgggaagtctcggaggctacttggtggacaggattgagagctgccttggagaggcctgagtcagatctgtttgccagatcagcctccactgggtttctactggaggggccatacacagggagatgcagggagaaggcctgagggagagatagagagccctgattgtgagctgtggctgcccaggccagataatggcaggggagagaggaggccccgatcctgggcccctgtctgtgctgtcggcctggtgcgttagctcctggtgccttctaaagaggcaacaaaagtacttcaaattgagcatgagcttgggttcaaatcacacctctaccgctaaaaaactaagtgccgttgggccagttacttagtcattctgaatctcagcgtccttatctgtaaaatggggaaaataagccaatagggttattgtgaaagatacatgagattaatgagtcttggcgatagtccctgctcccagtaaatgacggcgtgcatttttattgtcatcttgggtctccatcctttttaaaaaaatacttgattataacagctttattgagataaaattcacatgccatacaattcacccatttaaagtgtacaattcaggcagggtgtggtggctcatgcctgtaatcctggcactttgggaggccgaggcgggcagatcacttgaggtcaggagttcgagaccagcctggccaacatggtgaaaccccatctctacaaaaaatacacaaattagctgggcatggtggtgggcgcctgtaatcccagctactcgggagactgcggcaggaggatcgcttgaacccgggagatggaggttgcagtgagccaaggtcatgccactacactctagcctgggcaacagagcaagactctgtctcaaaaacaacaacaacagataaagtgtacaattcaatagttttttatatatttgtcacaatcaattttggcactttttcattatcccccacagaaaccctgtacctatcagcagtcagtcctgcagccgacccccctctggccccaggtaactgccaattactttctgtctctatggatttgctctttctagatgtttcatagaaaagaagtcatgcaacatggggtctttttttttttcttttgagacagggtctccttctcttgcccaggctggagtgcaacagtgcaatcacagctcactgcagcctcgaactccagggctcacatgaccctccctgctcagcctcccaagtagctgggaccacagtgcaccgccatgcccagcaaatttttaaaaaattgtttgtagagatgggttctccctatgttgcccaggctagtctagaactcctgggctcaagtgatcctcccaccctggcctcccaaagtgctgggattacaggcatgagccagtgcgtccaggcctgtggtcttttatgactggctttgttcacttttttcatccctgtcagcaatgtatgagagttctgatttctctgattccttaccaacacttattattgtttgtcttttttattgtagccatcctcgtgggggtgtgtagtgggatctcattgtggctttgatttgcatggccttgacggttaatgtttctggtttttttcagtggaatcccctttataaattctgggacaccctattcccagtgtggaaacactaacctgttccaaagaaagaaaaaaaattctagatggaaaaagatgttcattactgcgacataacatttcttaatacaagtgactcgtctatagcagtaggtagttcctaatttttttttttttttgagacagagtcttactttgtcacaggctggagtgcagtggcatgatctcagctcactgcaacctctgcctcccgggttcaagtgattctcctccctcagcctcccaagtagctgggactacaggaacataccaccactcccggctaatttttgtatttttagtagagatggggtttcacaatgtggaaacactaggccacattgtgaaatgtggccaggatggcctccatctcctgacctcatgatctgcccacctcggcctcccaaagtgctgggattacaggcgtgagccaccgcgcctggcctattatctttaataattataaatactgggctgggcgtggtggctcatgcctgtaatctcagcactttgggaagccaaggtgggcagatcactggaggtcaggagttcaagaccagcctggccaacatggtgaaaactcatctctattaaaaatacaaaaattaccctgtcatggtggtgcatgcctgtaatcccagctactcagaaggcttaggcaggacaatcgcttaaacctgggaggcggaggttgcagtgagccgagattgagccactgcactccggcccaggcgagagagtcagactccatctcaaaataataataataattataataactataaagaccagctatcatatggaaaatgtccctgatgtgtgaacaaatgcaggatggaaaaatactcagtgtagtcattttagctaatatatatttgttaaaacatccaaatatttttttcgagctcggcgctgtgtgccaagctccatgctggctcatggacaaagtcaggaaaagaacaagcaaaaatgaaattccttcttgtgtcgggagtggtggggttttgggggacaggtatctccccttccccatgttttcttctcaaacttcctccactgttgttatattacctttgcagtgataaaaccaagagaacagaagaaatacttctggacctaaggatgaaagaatgatgggagaaacatttcttgagccagtccctttctgcgttcttattttgtggaatccgcacacatccccgagaagcttaataaaaagggctactatcatgacacttactgtgtgccttgccggttccacctgttaggtgccattgttgtccccattttacagatgaggaaactgaggcggggcaaggagatgcccttctgcttggtggtctatccttcagcattacccacacacatgcagagctacatataagctcacgttcacactcggattcacgtctgcacccatgggcacatggaggatcgcacaagccacactcagacacacatgtgtgctcacacacagggctgcccatgtccacaggtatgtgcatggggacacgcatgtatatatgtgcatattcccatatgcacacagcacaggtcaaacacttttggacacacatctgcctgagaatgggaaaaggggtgcaagataaaggggcaaagtctggcttttgcctcctccctgcacctgctaccagctgtgtgcaggactgggtggggcagaaataggtggctctgagctcagagggcagaggtggccttgcactagaaatccacctgccaaacttccaaatgggctacagcgactaaggggcctcacctgctgggcaaatcccccagctggagggtgtgctccagatcctccaggggtccccagggggttgagaagatgaggggcacacccagcagcccctaagggaggaagcgtggccatactggctaagggggcgcactcttcttgcaggccgcctgatcagatgcctgtaaaataagacagctttacaaagagggtgtcggaatgtgaggaggcagagggacaggcatgagtagaaagaccttcctcaggacctgaagtccaatgatcctggtcctgcgtcccactagctaggtgatattgaacaagtcacataacctctttgaacctcaatttcctcatttgtaaactttgcacaaatcatttctttgactgctaaacaagtatgttttgaggaccaacgacatgccaggtacggtgctgggcactgggaaaacagcagcaagcaacacagacatgggcttgccgtgtagagcctgcagaattagggaaaggataaatggaaacatctcacacatagtaagtgctcagttacgttcctcctggtctctcttttctaccattgtaaaggcgatgcaataacatagaaagttgggagaatggggtggcggttgctgaggggggaactctgtcatccagaatcccaccaccccaacacaatgactagcttcatttttgccaatttcatcagctcatgcaggggttgacctgctgtagggcactcaaaatattcaaaccaattaatgcattgcatttgtgatcagaagaaaaaagctaattacaatgtaacagatttacctgatgcaaagcaacgcaagcatggccatccctctgcatatatggaagcttttccttttgggggaaacagcaatatttccattttacggaaaaagaaatggaggcacagagaggtcaaggcacttgcccaaggtcacacagacagaaatgcgaagagcagctccagaggccagaactcctgcccatcctgtccaggactgtgggatgcatccagggacggacactggggctgtgggctggatgacttggctgcctttgcattgattggagctgtttagggaacctaccccagccactagcatccagtcctagagacacagaaaattcactggccagcctcacttttgagcccagaaaccccttacccttcctcctgcctcttgagaggccagtgttaggtgttagccggggtgcaaagctctggaaggcaggtttctgctttctgctgccctccagtgggcaaagaaagcaaacctctggatccatctggaagcaggtagcaggtgttgcccaagtcagctgcggctaatagtaataataatggctgccgctcaatgagcacttaccacgtgcagacgtttttacacctaatctaatgtaacctaacccctttaagcaatttaattaacatttaattcctctctcaaggtaggaatcacttcctatatacccatttacatacataatctgagacttagaaaaatgacttcccaaagtcacaaagctggtcagtggcagagccgagagtgcaagtccttggagatcagaggaggaagagaccatgatcctggaccaggagacagccctgcattcttgggcacagaggtgaatttactgtgaggctggtgacgcatcagggctcctgacttgcatgtcctctcccagggccatggaggaactttccaacgcattcgcatgggcatatgtttcacatttgcaaaactaacacatttcagttgcaattggctgagaccactatctctctccactgcctagaataatgtcttcacatagtaggtaataaatatgtgctaataaatccattttgtgtttaataaatcatgttgaatgaatgggtagagaaatgaaggaaggaaggaagtggcatttagttcaatcttgaaggaagggcaggatttgagagagcgttcctcatgtagcctagtgggcccctccacacacagaccatccaaggccatgagtggccttgaatgccagggtgaggaatctggccttaggtggtaggcactggggagccatggaaggttgcagagcagaggaaggatatgagtgtaattgtcaattaggcaagagttgaatgtcaaataagaggacagggccctacagcggggggccagagtggctcagataaaactcccctcatccagcaccacacagagagctggtgctcagccagtgtgatcacagaagcctctgctggggtgtctataagctccctggaagaagatatccaaatgctttgcatgtgtggctttgtgtatgtgtgtgtgtgggggggggaggggaggtgctgagtgtggatttgctcagcactctagtgtgcccagcccaacgtgggggaaaggtcaaggccctgtctggcttaggcagggagttctcagcattgcagtatgactgagcctctggctggaaagtaagggagccaagagaaaacaggtttagaagttggctaggcagaagtggacctatgaaattccagctgcaccagctgcttcttttgctaagctcccgtcatcctttctctctctccactgggtctttctgaatgtcaagaatcccagccactgtttagttagcacttgttttttgccacactctgtgaagcaccttcaagcccgatcaccggattattcctccaacaacgccgagagtgagaagaatggctattatttcgattttataggtgaggaagtagaaagcccagagaggtgaagttgcttacctgaggtcacataggagtcaatggtatacgtgagatcaaacccagactccagaggcagcccccctcagtcgccagccgtcctgcctcctctcctggtctaagctggggaggaaaaacccatcttggccagcagggggcggtgtgccctcaaggataagccctgcttcccagaactcagacagaatttgccagcaagacaacagcacgattctgaaatatctggctttgagccctcatttagtcccaactctggtggggcctggagaacggggagaggggtgagagaagtataaaatagccctcaaattggtgagccaatggttcacagaaaggaaagcgcagcggcattttaacatataaaaagattctcattttcactcctaggaagagaaacgtgttaaacccacaccacctgagcaggcactgttttgctatcaaactggcaaacttatgcaggtggggatatggagacacactccttcttacattgttggtgggattaaaacttggttttggccaggtgcgatagctcacacctgtaatcccagcactttgggaggccgaggagggcggatcacctgaggtcgggagttcaagaccagcctggccaatatggcgaaaccctgtctctactaaaaatacaaacattagctgggtgtggtggcacacgccagtagtcccagctactcgggaggctgaggcaggagaatcacttgaacccaggaggcggagcttgcagtgagctgagatctcgccattgcactccatcctgggcaacagagtgagactccatctccaaacaaaccaaaaaaaaaaaaaaaaaaaaaccagaaaagaaaacttggtttaacacctatagaagctaatctggtaacatctatcaaaattaaaaatgcacatatctaacaggtatgcatgatacattcatcaaaagacttgaactagacctgcatgatctgatgtggagccacccaccacatgtggctgctgagtccttgaaatatggctgatccaagcctggctgacatggcaaaaccctgtctctactaaaaatacaaaaatcagccaggcgtggtggcacgtacctgtagttccagctacttgggaggctgaggcacaacaattgcttgaacccaggggcggaggctgcagtgagccaagatcgtgctactgcactccggcctgagcagcagagcgagacagtctcagaaaaaagaaagaaatatggctggtcaaattgagatgtgctgcaagtgtgaaatatatatgggattttgtatactaacaaaaatgcaaaatgactccttaataacttgctaatattgatgatgtgtcgcaataatattttggatagattggattaagtaatttttatttttgttttttatttttttgagacggagtctcactatgtcgcccaggctggagtgcagtggcatgatcttggctcactgcaacctctgcctcccggattcaagtgactctcctgcctcagcctcctgagcagctgggactacaggcacctgctaccacccgtagttaattttgttttgtatgtttagtagagatggggtttcaccatgttggccaggctggtctcaaactcctgacctcaagtgatctgcccacctcagcctcccaaaatgctgggattacaagcatgagccactgtacctggcctgggttaagtaatttttaaaattacttttacctatttctttttcttttttgaatgtggctgctagaaatatacatggcttgcattgtggatcatattatatatttttacctttttattgtggtaagatatgcataacatttaccatttggaccatttttaagggtccagaagttcagctgtgttaagtacattcccattgttgcgcaaccatcaccatcatctacccccagagcgttttcatcttcccaaactgacactctgcctctataaaacaacaactccgcttgctcctctcctcccagcccctggcagccactattctactttctgtctctgtgaactggactattctaggttgcctcatacgggagaaatcatatacaatttgtccttggttgctggcttatttcactcagtatagtgtcttcaaggttcacgcatgttgtagcatatgtcagaccttccttccttttttaagactgaataatgttccattgtaaggatataccacattttgtttatccattcattcactgatgggcatttcggttgtttccacttttggctatggtgaatagtgctgctgtgaacattttggtacaaatatctgtttgactcatattttcagttcttctgtgtctatcatattttattggacaggactatgccagtgatctccatagccacataatttgaaatatccctaaaccaggaactacccaaatgctcatcgacagcagaacggataaattgtggtatcttcatacaatgcaatactccagtgagaatgaaaatgaatgaacaactacacacagcagtgtagatggaacttgcacacatatgtgtcgagcaaaagaagccacacgcaaaataatacatattgtgtgattccactcacaaaaagttcacaagaggcaaaactaatttatgatgttaaagtcaggatgatggctgctctttgggggccatctgggggcttctctggggctgacaatgttctggacaccatcttcaggagcgtggtcactccgtgaaaattcatcaagctaagcacttgggatttgtgtgcaactttgtgtataagttagacttccataagaaattccaaaagatgctttgatccagcaattccactcttaggaattaaacgacagatatattttcatatgtgtgaaatgaggtgtgtacaagattatccactgccgtttttatcagcaaaagattggaaacatgccatctcacacctactaggatgactactatttttaaaaaatgaaaataagtgttggtgaggatgtgaagaaattggaaccattgtgccctgttggtaggaatgtaaaatggtataacagccacggaaaactgtacagcagttcctcgaaaaatgtaaaataaaattaccttatgatccagtcattctgcttgtgggtgtgtgcccaaaataactgaaaagcagggtcttgaacagatatgtgtacacccgtgatcatagcagcactattcacaatagtcaaaggtggaagcaatccaagtatccaacaatggacgaatgaataaacaaagtgtggtctatatgtaaatggaatattattcagccttaaggaggaaggaaattctgatagatgctacagcgtggatgacccttgaggacactatgctaaatgagatgagccagacaagaaggcacaaatactgtattattccacttagacaaagtatctgtctaaagtaggctggatgcggtggcttacgcctataatcccagcactttgagaggccaaggtgggcagaccacctgaggtcaggagtttgagaccagcctggccaacatggtgaaaccccatcttaactaaaaatacaaaagttagccaggcgtggtggtatgtgcttataatcccagctactggggaggctgaggcaggagaatcgcttgaacccgggaggcggaggttgcagtgagccgagatcgcgccactgcactccagcctaggcgacagagtgagatccgtctcaaaaaaaaaaaaaaaaaaagtagcccaattcatagggacagaaagtagaatggcaattccaggagctgggaggagggggaataggatgttagtgtttaatgggtacagagtttcagttttgcaaggtaacattttggagaggtttggtggtgatggttgcagaacaatgtgactatatttaatgccacaaaactgtacacttcaaatgattaattagctaatttttggtttttttttttttgagatgaagtctcgctgtgtcacccaggctggagtgtagtgacgtgatctcgactcactgcaagctccacctcctgggttcatgccattctcctgcctcggcctccctaatacctgggactacaggcacctgccacaacgcccagctaattttttgtatttttagtagagacggagtttcaccgtgttagccaggatggtctcgacctcctgacctcgtgatccacctgcctcggcctcccaaagtgctgggattacaggcgtgagccactgtgcccttcctaattagctaaattttatgttatgtatattttgctgcaattaaaatttttcaagtgaggtatctataaggaaaggtgagaaaatatgtaagatacaaagataataaaatccagagcaagaacagtatataagtcctgtttccttatgttgaaatatatcaaaatattcaacagaagaccccaggataggaaagatgtgaaattctagactggatcatcaggtccgacggatttacaaagaaggtggccgaggatctctctccccagccttcaccccctcactgactgtgggaaaataaagggcttggggtttggggaggaggtgttgcaggaggagcggcagctccagctatgagacctcacccagagggggccaatactgcccctccagatgccaggcaggggacatggaagggtttggggattcgttgtgggctggggtgggggtagcttgcaggggtctgcttgggtcttgttccctagggcctcctggagggtggagtggtcttagcagcaagaagctggagttggatgttggattcctgagggccgaggaaggacttgcaagggacctccagaaggagaagtgcatcccccccagggtcaagagtgagggagccctgcagcaatggccatctgtgggacatctgtgacactgtcagctggaagccagcaggatggcggcagctcaagtgagacccttcccctccccttactatctccacagcccccacttgtgggggaggggaggaggtccagagaaggagccccccaaactgcctccccaggacaggccccagctgggcaaggggagaaggtttaaacctagatccaattgggagtttggattaatagcttgactggacattttaaatttgagttgagaccatgtttgtgacttaaagtgatggtagaactgtcttatgtaagaattggggccaggcacactttgggagtccgagacaggtggatcacttgaggtcaggagttcgagaccagcctggccaacatggcaaaacctgcctctactaaaaatacaaaaattatccaggcatggtggtgtgtgcctgtagtcccagctacttgggaggctggggcagaagaatcgcttgaacctgggaggcagaggttgcaacgagcagaggttgccccactgtactccagcctggatgacaaagtgagtgagacttcgtctcaaaaaaaagagttggtcccattctccagtgggctagccttggcttgtctcatggtggaggaggctggcgggggtgggtcaggttcaggggggtgggggaaggtggggagcagagggtgggagagagagagagagagagactgcaaggactgcattctttttgaggctcaggctcagaactagcacaaggtcacttccaccacattcaatggaccaaagagagtcccaaagccaacccacattggagagaacgaaggcaaagtcacattgcaaaggggtgtggaaacagatagtggtgcagaatctggcccgctttcataatcagtccactggaagactttgttttcctcgcaaggaaggttggaaatgtagactcactgcttgtccaggcagaagaggaaatgagttcagggaagagcttgccagtccccagcctttgcccagccccctactcatgcacatttaggcacacacctactgtgtgctcagcccagcagggtagattagagagagcgagggcgtcgggatagagggcctgattccccaaccgggtgactatcacttccggtctcatgacctccatgttctcatctgtaaaatggggataaacatcctcatcatctctcctgccattggtatggtggtgacaaaaaacactttatcgattcatgaaagtcatcagacaaagtggatgatgctgtccctgccctcaaaggtgttaaataaagaagatgagaattcaatacatgtccccagctctggtgagactgtaggggttgtgttaacaagggagggagagacatcagagagctgttggcaggggagagccctgtggccaagccttgacagatggtgaacagaatctggaaagacagagggcatggggcatggcagggtgtggaaacagcacacttgcaaaagtgtggaggctggacacatgtgatataaggcagggtcccctaccccatgattcaaagcagaaattcgcaaagactttgatgtaggctgggctgggagttgactacacttgcatgcctgttgcttggcaggatggctttcaaaaaagaaaaaaatataataatgaaagattgaaaacagattattggggagaaaagtatcccaggcgctagacggctgtctctgcagcctctggctcctgtcccacccattccccggccctgacgcaaggctggctggaagaaggtgttctcgagattgttcaggctgagggcctgactggcaggagactgaagcctaccccattcctgcctgggtgccaagctctgcatgaggtttaaatatacccacagcctgacactatgccctagatcatgctaaatgtttccatactccttgaattctcttctcaaggttcatttattgtccccatttttcagatcagtaaactgaggcccagagaggttaactggtttgcccacagtcacacagccagacaagtttgagtatgtctgattctattgccttattccaggtttgggatacaggcagagtagggagaggtttaggatggtaaagaagaatgttccaggaggaacagagttagtgtaagggcagtctaatctagagtcagaatttggagctgtttgttacagcagcatgacctagcctatcctgactgatacaaatcatggtaaactaatttatatgtcctgaaaaatattagaacttagcatctacctcttaggagagcttttttttttttttttaacttttacattttggcaaaacacaccgaacataaaatttaccatctaagcaattttaaatgtacaatgcatggctttaagtacattcacattattgagtttctatcaccatccttccacagaactcgtcatcttgcaaaactgaaattctaaacccattaaggaaacttctcatttccccctccccagcccctggcaattccactttctgtctctatgaattggactacttttgacagatacctcctataaatggaatcacacagtatgcatctttctgtgactgatttatttcacttagcataatgtcctcaagcttcatccctgttgtagcatgtatcagaattgccttccttttttaaggctgaaaatcttccattgtgtggatacactatattttgcttatccactaatctatcaatggacacttgagtgcctttcaccttttggctattgtgaataatctgctatgaacatggacacacgaatatcagaggcagccttttcaagcaaagggtttttggggaaaaagccactgtccaggactctaggcttggccactaacttgctgtgtagctgtgggcacattgcttcctgcatcgtgtatggcaattctaactctctccaccttcactgcctactcacagccgtgtgctggggaccagattagaccatggactatgaaactctcagcaaagaaaaagccacgaggggctgttattgttattactcagtggggtcagggcagtggcttcccaaaggcatgagtcactcatggtggaattccagacatcaggagggccgttctgggcagcagagcccagattccagacagagcagtgaccctgacccggagcccctaggggagccacaccctttctctttggccactggctgctgtgaggaaggagtcagtgaatgtcataatcatatgggcacttagggtgagagcctccagtcccactgcctcacgtaactatttaaggaggctcagaaagggtcatgcacttgcccagagtcacacagctagacagtggtggaagctggcctgggtcagatttggacatctacagaagcccttctcctccctgctcgcacccctcttagccccagcatgtgaggaaggcagctgtctccctgagctccgtccttctatgccttgggtttagccatgttgactgctgtaacaaataactccaaaacctcagtggctttgcattataaatgcttggttctttctcacatcaaactgcaataagtcttgacaggagggctctgttttctgcaggtcatatagggattgagacttttcctatttgtggctttcctcattctcagagtcctctccattcagcaggcagatggcagaaagattgtgggtagaagatttttataagccagacctgaaatcagtacaattatttttgcttacatcccattggccagagctcagtcacatgaccacatctaactgcaaagaaggctgggaaatgtatcccacatgtgtgcccaggaagaagaagatggctattggtgagccttggtagtcttccacaagaacatgacccagttctggccaataaaacataaagaaagtatgctgggacaggaggtttgagaagggctggcctcaattattatataaaaaggggtgtggggaaggtcccctattctttccctttaagtggttgcatgaggatgcgatgtctggaactttggcagccatgttgagagcatgacgggccaagcctcagggctacagccaatatactgagggtgctgaagccaaaatgcgggtcctagatgacatcactgaacctctgaatgaaccaaaactggagccacgtaacctccagatttcttgactgcgaaggcacctattattgaattcaggagtaatagggtattctattacttgcagcctaaaacatcctagctgattgacactcaggtgcaaatgctgaaaacagctaagaggacaaggttaagccatgccagctgttacaacgaataactccaaaacctcagtggctttgcactacaaatacttggttcccttgaaacccctcctctgcttgaagttaggtagagccaagtaacatagctttggcctactctggatgttgtgcttttttggggaagttggggacagagcagcagttcaagcacaaaatgacctggctgctttgtgccaggtcctttatacacacagtgtatacacgggagcaaaatgcctggactcaaatcttgagtctgccacctcaccagccatgtgaccttgggcaaagtcaatcaacctcactgagccctagtttccccattgaaaacattggggtgattataaatattctacccacagagtaaaggattaaatgtccaattcagataaagaacttggcacattatctgtaaataaacacttaaaagattctgaccagagcctggtgggatgtgagtaatatcaaccccaccttagagatggggagtctagggttcaaggaaatgaagtccaaggacatataaataataagagacagagcctggattttaatacagacctaattgaacacctgctatgtgccaggcattgtgtgaggtgtttagatatattatcccattgaacatactagcaatcctgcatgggaggtattattattatcattattgttattcctattggacaaatgagaaagccaaaactcagagaagtgaaaagacttgcctacaggccaggtcaagatgcagtacttgaacctaggctgagtccaagcctttattctttccaccatgtataagcctccctaacagaagcccaccagactattatagtggaattgtaggcatcagaggagtaatacatttggctcccatggctattcagggttccctgaagtcatccccaaaagctggctgccagtccagcctgtcaccaaggttgtcctggtgatggctttaccctcactcctccagtagaataactgggccctggagtggatggtcctgagggaggaagtttggctcacttgataaagcagaactttcaaacactttgagctcatccatgatggaataggctgccttgggatgcgatgagttctgtggtcctgggaggatacaagcagagaaagtctggtggccacctgcaaggaagattattaagacagttactgcatagaaagtgaaattagattcaaagacctttcaggtttgaaatctgtggttgcaagattctcaggtcccattttctcagattccagtctaagattacatgatactcaaaatccaggaatctaaggctgcacgagttttctccttggattttttgttccctatttaggcagttagactgcagaacatctactgactcaggaaacagatgtgttagtaaaagcagagaatacatttctgggtttcaaaaacaccccttcctcccaggaaagaacattcctaagagacttgggcatcttgaacacctaatgaatctgaaagaggctctcactttctgtgactgtctttagggactgtccacaaatactctgtttcttttccttttagggtgccttagtctgttcaggctgctacagcaaaacatcttagactgggtaatttataaacaacagaaattcattgctcacagttctggaggttgggaaattcaagatcaaggctccagcagactcagtgtctggtgggagcctgtttcttatagatggtgacttctgtgtgtcctcacatggcagaagggacagatgggctccctcaagcctcttttacaagaacactaatcccattcatgggtggagccctcctgacctaatcaacttccaaaggccccacctcttaaggctatcactgtggggattaggtctcaacatctgaactttggggaacacattcagaccacagcacaggcccatagtaggatttccacttgaactccctcctctgcttgaagttaggtacagccaagtaacaagctttggccaatgaaatgtgtgcagaagtgaagtgtgccacttcctgggggagactttaggagccagtctgtggcttgatgctttctcttgccctctgctgtgcaacagttgaaatggtggttgttctatcagctgggatccaggagcaaggagacacagagcagcgcagcagctgcccagcaggggacgtgcatcaggagccactgagaaacaggacttgagcgttgctgttactgtagcagaactcaccctaccctgactgatgcacagctctcccctcccctccctccttcctcccatctaagaaggctgggaaggaggtcagagaaaaagctatgagtgagcatattttggattttgttggtcagtgggccccagagagctttgaagaattcagaagcagagagcagggaggatctcaagagataaaatggccaagagggccagagacaacctcacgcctagatacaattggggaaaaaaaatgaatggagctgggaaagtgatggggttggggaaaaaaatcccaattgaataagatgaattttctgcccacatatggaatggagcattgaaatgagaatgaatttaaaatagattacatttccagcccatctgaatttcagactgagaatatctgctgcacataattcaagatcccacagtctcaagaggcttgggtcctgggctttgacaatgactcttttcctgggcagaaggttgtacatggacactgggagcacctaggcctggaagctgggagaactaggctctcctgtctgatgtcactttccctgtcactttcccagggaggccttccctgactgcctgacttaaaaggaacttcctctaccaccctggccattctctattcctcttcttaacatcaattgacacaccacaagttttcattttttttttttttttttcttgagatggagtctcactctgtcacccaggctgcacccaggctggagtgcagtggcacgatctcagctcactgcaacctccacctcccaggttaaagcgattctcctgcctcagcctcccgaatagctgggactacaggcacgtgccaccacgtccagctatactgatgtgtttattgtctatttccccacttgactgtaagtttcaaaatggcagatattcctctctctctctctccctcttttttcttttcccttttatttataaaaaacttcaaacatacagaaaacctatcatgaagacccatttaccgcttacccatcatctagatttccaactgttaacattttactgtatttgcatcatgttttttggtgctggcattttctgaagtatataatattcttcactatatttccttttaaaaaattgaagatggccgggcgcggtgtctcacgcctataatcccagcactttgggaggcggaggtgggcggatcacgagatcaggagatcaagaccattctggctaacatggtgaaaccctgtctctactaaaaatacaaaaaattagccgggcgtggtggcgggtgcctgtagtcccagctacttgggaggctgaggcaggagaatggcatgaacccgggaggtagagcctgcggtgagccgagatggtgccactgcattccagcctgggcgacagagcgagactccatctcaaaaaaaaaaaaaaaaaatgaaggtaaggagttttgtctgttgtattcactgccatattactcactgcctggaagttggtaggccttcagcaaatagttgctgagtgagtagaaggcgttaaatcctcatgacaaccctgtgcggtaggtgttattatcccccattttacagaagaggaaactaaggcacagagaggaaaagtaacttccccaaggccacatggttggcaggtgatgaaagggggatttgagctcaggcaggctgagttcagagcccatgcatttagcgcacaattgctctctgcgggcaatggccattcatctccaactgggatgtttattcatcctctttagataccatctacagaggagacccagaggaagaagaggggctcacaggctggccaaaagcaggtgatcttcctctggggacctgatgctctcacaaagcctggggccttctgtcctgccctggggtggagacagaagactccttcccagacgagtgacctttagggtttgttatgaatagagattccttctggggaacgtgatggctgatgctgggaacccgggtccccagatttaacccctaggaatgtggagaggaatctccagacctccacccaggaggccagctctcccagccacccaggccagccagaagagggtggttctaagcagctcttccagttattggaccactgggaggtggactggaaccttccatgtccaggctgggaggcagctcctcagagtaaaaataactctaggcttcaaaatcctggggtctgcctcttcctccccagctatgtgacattcactggacaggtgcctcatgtggggggactttggttttcacatcaatctaatgggactaaatattataccaacctctcagcagggctgggactagggtgaagccagccaggtgctcaaggcataacatttagggaggtgcttgttctgaggcgccaaccctgcacttgctcaggccccggggtgagggcctcggtagatttgcaccctggtcaccttgctgcctcaacctggccccagccctgcctcccagggttgtcgtgggaaggaaatgagatattgtatacaaagcatgttagcacagcatgtagcatgcccttagtgctcacttgtggggaaaattctgttattgttctttttttttttttttttttttttttttttgagagagagtctcgctgtgtcacccaggctggagtgcagtagcacgatcttggctcactgcaacttctgccttccggattcaagtgattcccctgcctcagcctcctgagtagctggattgcaggtgtgcaccatcatgcctggctaattttttttttttttttgagacggagtctcgctctgtcgcccaggctggactgcagtggtgtgatctcggctcactgcaaactccgcctcccgggttcacgccattctcctgcctcagcctcctgagtagctgggactacaggtgcccaccaccacgcctggctaatttttttgtatttttagtagagacagggtttcaccgtgttagccaggatggtctcgatctcctgaccccgtgatccgcccgcctcggcctcctaaagtgctgggattacaggcgtgagccaccgcacctggccaatttttgtatttttagtagagacggggtttcgccatgttggccaggctgatctagaactcctaatttcaagtaatccacctgcctaggcctcccaaagtgctgggctaggattacaggcgtgaaccaccgcacccagcctgttcctattatttttattgactgcctttctgaggttggctgggcctgtttcccagcagtggccctgccttggacctcttgccatggccttcgtctctccctccacttgtacatattataccctttttattatttatccccttgtagcatggtttgattcccattatttactggttccttgtcccatgtctcctcctctgtgtcgacagcctggaaacaatgattgctaatatttaccaagtgctcaccatgtgccaagccctgggctaagcatttacatgctggatttcatctcatctttacaatgatcctatgaggtagggactatgattatacccatttttcaaatgaggaaatggaggcacttaaaaattgagtaacttgcccaaggatgcattgttagaaaaggatggagctgagggtagaatcaagatggcttaatccctaaaacccaagggatggaacccagaacactgcctcttccactcttcaccagcttctgccctgcagggtacacgcagatggctccaagcaggggccccattgctcactgggggaaactggcctccctgagctaagtcaggtcctgggcagagggacagatgctctctgtgcatctctaggccacagcagggcgtttccaagtccttcccagaccagacggcggcttctgctgtaggctatagtaataacaacagcgttgagcactcacactgtaccagagcaggggtggcgccgcgctgcacacctgccgcccagggtctccacagtcctcacgctgcccttgcattgattattgtctttatgtgaccagtgtggtagctcaggtgtcaagacctcaaggcacccagccagggtcgcatctcacgtctatggcagatccaagatctgaacttggacttgtctgaatcctggataagctggggggtgaagctggctgctgaggatcctgtgtgcccctcagccctgttcccaccacctctgtgcctcctccctgctggcagccactgtggccacaatggggttaaccccagaggaaggcattgaaggcgctggggctggggtgggaaggaaggcatatttcggggctccaaggacttgaagcctagctgctccatgcccaggctctgggaccccccaatacatgcacacattgtttaaaatgaagtggaactccaggcaggcaagttttgatttaggggagacagctcctccatggtaatgatactgagccttgttatttgagcaaataggttttctcccagcctctcactcctttctttgtaattcatcttccatcctggccacatgcaggccctgcttggaactctctggggactcctaccccacaggatagtctaaaaccctgccccggtattcaaggctgtttgcagatgttcctcaaccccaccacctgttgctcccaaaattcacacaccccagacctgcacaccacagttgttgctattccacacacaggtcgctgggagcagcgcacggcccagccccgcctttctgcaagtggatccctctgcctggaaagtcctccctcccctcctctggatcctcctgggtcaggctgggtgctcctctgaactcccaggctgagggttgctgtgtaatttgatactacattgacattgcaggaagatcatgtatggctgagtagctaaaaatgcaggctttgaacttggatgtgggttcagcctcagctgtatctcccgccagctgtgggacattgggctggcgtctctgagcctcagtttgcttctctgaacatagaatgatacgccctactccattaaggtgctgagggtgaaggaaaccacgggctcagtgtgggcagcttggccagggctccaagcgcatcgggtgttcatgtagtccttctagtgccaggcggtcattagcaacttggtgccagtctctgagctggtctccaggacggagcagtggagggaccatgtagcccctgctcccacaaacacagacattggacagccaattagttaccccagttcgttaccatggagactataattagggattatagtcaccctgcccaagcgcacaggcctcacctcccatccttgccttagctttgaagctccctggagcaggatctaaactggatttgtctctgtaacctcagttcctcattattcatggtcggaatgctcagcaaacgtttaagtggaagagatttccataacaaacacttgggagttcagaggagcacgcggtccaacctgaacagagcaggaggatctcagaggagggaggccactaggtaggatgcggcggcactaagggtagcacttagtttgtgacaaggactgttccaagcacaccacttggatcatctattaaattctcacttatttatttatttattttaaaattgtgtttatttatttatttatttatttatttatttgtttgttttgagatggagtctcgctttccaggctggagtacagtggcacaatcttggttcactgcagcctcttcctcccaggttcaagcgattttcctgcctcagcctcccaagtagctgggattacaggcatgtgccaccacgcccggctaatttttgtattaagagatgaggtttcgccatgttcaccaggctgatctcgaactcctgacctcaagtgatctgcccgccttggcctcccaaagtgctaggattacaggcttgagccactgcgcccagccagtgatcacttatttagatcacttactaaaatcatttaattatgtcaacacctctgtgaagtatgtactgttatcaccattcccatttcatagatggggaaactgaggcacagaaaagctaagtaaactgctcagagttacagagcctgcgagggccacagccagaattcaaacccaggccatctgcctccacagtccactttctatgtccctctcccgagatgatgtccctttcccaggggtgtctggaaagggtctggcccctggtcccagctcaagcagctgtccagggaagcctgaagacctggcccatctccactgcccaccgggcttctctgcgctccacttcccaggtggactgtggaggcaaataaggccccagctgcagcctctgaagactcctgccaagctggcactttgaggcctgggggtgtcccaggggatcccagcccagcagctgggctgacctcagggccagtgtttccgtaaacacccggagagccagccccacgtggttgatctgtgggttgctggccaagaggggctgaggtttggctgacctcgtgcggtttctttcaacaaggctacttccaccccctccgcctggctgggcttccagtaatgaagtgttttctctggggctaggggagctgatggggctggtggcgtggggcactggggtcttcctgtcccacgtgccctccaccctgggcttctggaagctggtctagatgcccctagctgccgcctgggcagcccatatgcccacgccggtccctgatagtgaactggcccgtaaggggaccaggtctcgggatctgagcatggagcaggggctgcgcccaggagatagggtgtggctagactttcccctgctggtcctttccggggatctgaggggaaacttctcctggggacacacccgggtagctcagagatggaagaaaaggtctccattacagctgccacctcttccccacccaaagagagtgtccgcagggggccgtggggcaggagtgagtactgaaggaatactaaccacgatcactgctaccatctcctgaatgtcactgccccagccctttaattctcacaacaaaccttggaaactgaggcttagagagaggaagtggctggcccaaggtcacatagtgagtaaatgagcagagcttctccccctttcccttgaatcacctctatcttcctgtccagatgccaggcagcaggaactagcaggtgcttttgggtcatcttttaagaggcaatatagcacaatgagtgagagcagggactcaagggccagccacctgggttcaaatcccagctctgcttcctactggctatgtgaccttgggcaagtcactcaacttcttggttcctcagtctccccacctgtataatgaggataataatgatgcctcctttagggggtttctgtgaggattgcatatacacgtgacacataataagccctgtgccatgctagttatcccagcctctcactcttcccattgaaaaggtgaagacacagacccagagatggaggcaaattctgcaggggtcatgcccggggcagagcatggttcagctatgtctcctatggtgctgccaaggagccaccatgggcttgagctgagaggagccacctggcaccggacacgtgacctcctcgagggaagggaggctctgcagagagcaggggatggtggaggagcctggctttatcttccatccttcaggagcggggaagggcagtgtcagagccaggagaggagagaagcgaatgaacgtgctgtgtgagctccagtcagtccctactgactctgggcctgtcactcctgctgagggactcgggtgtttggacttttagacttggaggggctcctcggtggggccttgggggctgctctgggtgagggctctcaccatttgcttcatcccaaaccactgtccttgggcctgttttaaatattagagtgtagcatggggttttgctgctctaacaaagggtcagccatcttgagaaggaggctctgtgatgagcagggaatggggctcccctgcccccccgagaccctggggcccaagctgatgactggccagtgactcactcccttctcagcatgtcctgtcatcccatgactgggagcccctcgggggtggctcctaaccaaggtccccctgaccaaggcctccccccaccctccccctaacacacatagagactgggaacaattaactccctcctaaggccagaccagatgttcacgtgggcattggttttgttgaccacatgtgactcaggagctccctcagagctggaagagtcccaagaggctaaaagggcaacctgtcacgtcacagctgggaaactgagtcccagagaagccaggtgagttgcctaacatccctcaggggtagaagggaggaaggaacctggagttcccatgcctgacccagaggctttctacctctccaaatagttctcggatgtgcccaaggcctcagtccccattcctacctccagttgcaaatgtcctccccaactacacagagcctctcagcttcatcccaccccacctccaactggctctcatggtttcatccaggctcagctacttgcagctccccaaatagctcctgctgtcaggccacctccaggcctttgtactctcctgctgctctgttttattttcctcttcacctggacaactcctaatcttgctccaagactcatctcaggtgtcaccttctccaggaagcctttcaaaaccacctcctccacctcccaggctgggttaggtcctccatctcttcaccctcagtacctagtatctcccacttactgtgctggaatcatctctttgcttgtctctatattgccctctagtctgtgagctcattgtggacagagaccttagtttttattcttaatagtagggaatgacctattacattcggtgtttgctgaatgaatgcataagtggatggatggatgaatgaatgaatggttggatggaagaatagatacatggatggatggattgatggatggatggaatgagtgaccaaatggtagatgaatggacaaatggaccgacaaacatggaaggatggatggatggacagatggattgatggacaggtggattgatggacaggtgggtcgatgggcaggtggatgaataaatcaggcagataatggcatctgtagggactcagacagtgagggctaagtccctggagcctggatatcctgactgatgaaggtgctcttggatgggaagggaataacctaacctgttgtcttcctactccaagagatatttggtccagaacaaagccacccctgccctggtgcctgctcccttctgaccaacaggttccaactcagtggggtctcctgaactctggtaactcatctgacaccagagcctataggaatcaccctgtctctgacattcagggattctgcattcctgaggccctccctccctgcctctcttcaggtcagagctgccgccccataaatgctttcaagcatagaaacatacacccctagagccaggaagttgtaaaaatgatgggattcacccctctaccatttttgcagatgaagaaactgaggctgagcaaggccaagaaacttgcttaaggacacacagcaatagagctgggataagagcttgggtctttcaattcgtttattcgttcatacagcaagtatgtatctagcgcctaaagtgccaggctcagtgcctattcccgggcatgctaggcctgtgcataagctttcatgttaatttaaaagctatttccatcctccatatgacctcctccagctccccagcaggctggtctatgcctcactagctgcatgcctggcatgatccctatgacaacaccctctcccagcaaatgaggaccacttcattgtcaggaagcctggctgggactggtgtgtgctgccgtgtgcagaggaggcagtcacatgtgtgtgctgtgagctgcacattccatcctagccttagtgaggaccgtattagtccctgcacgctcatccttgccagctcagactggagccaagcattaaactgttcaagccccacagctgccccaggcgagccattgcatggcacctgggagctcagggccaggagcagacctctgaattcctgcccaaaccagggaatatgtggtgagaggaggtcatagggaggtgcctgggggctggacatttgcaagccagctgagcaggcagtactcagcactttcctcttcacccctcccaccatggcaaaggcaggggcagcgtgggctagccagccttggagagatggagcctcaagtctaggggcagcagcccagcctcgggcgagccagggctatttgctgggccttctatgaggcttccatgaagtatgtaacctcgccgaagacatggaactactcagagtcattaagagccaaagaaaggctcagctgcgtttaacagaaaagcttctgggaacaaatcaatgaattggagaacaaaggaagactgcagaagacgaacagaaccagaagccatgtctaggatgaaatcaacatgaggtagagaatcctgatgacattgatcaggatgaaagaagtatgaggcaagggagtaaaatcaaatgccgagtaaaaagggggaacaacgttgaccaaggaatttgaagttaatttaagagctgttatgaacaatacaaaaaagaaaattataggcccatttcacttatgaatatatagatagaaaaacactaaacaaaatatttgctgactgaattcagcagagttaaaataatgacaccacatcaccatcaggaagcgtttatcccggaaaaacattccagaaaatccaccagtgtaattcactacatcattagatccaaaggaaaatctatgatgtcaattgatgtggaaaaattttttgataagttccttttgtatttatgatgcttacaaatttgaaaattctgggaaaatggagaaattaatagaaaggtataaaatgtcaaaagatgggcccaagaagaaatagagaatttcagtaggtcaatcagtattacagaaactgtaatggtgtcaaagccctcccactcccctaaaaatcagcctagatgttctcatgggtaagtactgctgaacctttttttttttttttttttttttgagacaaggtctcattctgtcgcccaggctagggtgtagtggcccaatcctggctcactgcaacctctgcttcccaaggctcaggtatcctcctgcctcagcccctcacgtagctggaactacaggcatgcaccaccacacccagctaatttttgtatttttagtagagatggggttttgctatgttgcccaggctggtcttaaactcctggactcaaacgatccacctatctaggcctcccaaagtgctgggattacaggtgtgagccaccgcgcccagcctgcagaaactttttagaaacaattaattcgtatcatatgcaagttgcttaaaaagaaaacaaaagaaaaaaaaaccaacctatcttattttaaaagtgttgtcttgattataaaagccagataagacaataccacaaaggaaagtataggtccatttcacttatgaatatggataggaaaacactaaacaaaatctttcctgactgagtctagcagagttaaaataatgatactacatcaccatcaggaagggtttatcccagaaaagtatccacatctgaaaatccaccagtgtaactcactacatcattcaatcaaaaggaaaaatccaacgatgtcagctgatgcagaaaaaggttttgataaggtctttatgtatttatgatttttaaaaattcttagcaaactaggagcatgagagaagttccttaatttagtagggatttttaataccaaaaacctacagaaaatattgctagtggagaaaagttttatataatacatgccttttaaggtgaggaacaaggcaagaatgctagttattactgctactgtttaatacatagagctggagagctgggctgagctacaaggaaagaaaataagaggtgtaattattggaagggaagagataaaactgtcattgtttgtagatggtgtgatcatctaccttgaaaaaccaaccaaataaactgacaaaatattagaacaaataagagagttcagcaaggttgccagatacacagtcagcaacaaaaatcaatgacgcttttacatcagcaataactaaccagaaaaacacaacataattttgacttaaatagaaaggttttaaaataatatatacatataaatatattatatataaaatgcatatacatatatatatacacacatgcacacattttaaaagcacagctggctatggtggctcacgcctgtaatcccagcactttgggaggccgaggtgggaggactgcttaagctcaggagttcaagaccagcctgggcaacatattgccaaaattttttaaaaaaacatttagccgggcatggtggcacacacctgtagtcccagctactaagggggctaaggtgggagaactgcttgattccaggaggtggaggctgcagtgagccgtaattgcgccactgcactcgagcctaggcaacagagcgagattctgtctcaaaataaataaataaataaaggtatatatatacataagtataaaaatagcgtatatatataaaacattatatctctctctacacaccacacacacacacacacacacacacacacacacattattatgtttctaatcacatgaatgaaatctacatgtagggtgcatttggcagctctgggtgtcatcagggatctgagttcctttatttctccttcgccctcttctgcacacgaagtccatcctcagggtaccctcatggtccaagatggctgcagaactccaccatcacgtccgtattactgactggaagcaggaggcagcaatcagtggtggtggagtcaccaaagggaagcccttccttttaaggagcctttccagaatcggcacacaacactcctgcttgtatctccgtgctggaacctatcccgtggccccgcctcctgcaaagctgagtgcgtcgccaccccaaacaaaaaaatcagtgtttggtgactgagggaggagggaagaaggatattggaatgggcattgatcaggctctgtcacagatctcagtctccaaaacacgaaactggggcactgaggtccagagaagtgagggaatttacacacagccacaaagcaaattagcagcggagttgggattttcacctgactgttgaccttcccatggtacaggtgtcccctcacaccctggtacatccagccactacagcactgcccctcctcacttccagccctgctggggtcaggatctgttttgtatttctctgtccccactacctaatgtcacacctgtgagctccacctccccagcgtcggcttgggacttggcatggggtagaggccgtaagcgggaaagcgggcacacacctcgggagctgacaaactgcaaagggctttcaaccgcagatatttacttgtggcttccatatgctgtaccttgatggtgatgtttcgtaagtttcacttttcagatgcattttttttttttttttttttttgagatggagtctcactctgtggcccaggctggagtacagtggcgcgatctgggctcaccgcatcctccgcctcccggtttcaagcaattctcctgcctcagcctcctgagtagctgagattacagatacgggccaccacgcccagctaatttttgtatttttagtagagacaaggttttgccatgttgtccaggctggtcacgaactcctgacctcaagtgatctgcctgcctcggcctcccaaagtgctgggatgacaggcgtgagccaccgcgcacggccagatgcatttcttagacgctaaaaatgttcagcctggcccaggcctggaagaacatgcaggccgcttttatttttatttttttttaacagatggagaaactgagacccagagaagcaaaagtgtgtgtcccagatgccaaggtacctgcggcaaagaatattacctagatgtccctcactctggttctccttcattgatacacatggaatgatggtatttccccgccttccttgcagttaagttggggccatgtggctagctctgactaataagatgtgagtagaagtgatgatgtggcttctccatccctcttttttcctgccaaggtgaccttggaggccaccggtctagaacagggattcacaaactgtaatgtgcatgcaaatcacctgggggtcttactaaaatgcagatcctgatagtggggtctgggagtctgcatttccaacatgcaaccagctgatgctgatgccatcggtccttggaccacacacttgagtagggaggagctacaggatgtgcctggcccactttggaccattcacgagcaagaaattagcttcactgggttaagccactgagatgtgggcattagtttgtgatctcagcacagtcttacggaaattgtcatttagccatcaaccaacattgactgagttcctaccatgaactcctgtgtgacctgggtgcctcattctgaatgaggtgctcactcttggggttgtgcaagtgcaaggtcagcagctgagaatgagagcctccctaaatgttatacccgacatgcctctgtcacctcaccctggtcccagccctgtaagtcggtagcgggagccgggatttgaagctcggacctgttgacttctgagcttgtgcttcctcctgggaaagcaaaggacagccacactcaccctgggcccttgtgtgggggctgcggctgcagccaaaagactcatgggttccctggatgcttatatccctctggtgccaaaattggacagtttgaagggagggctgaaccgcagcaaaccaatcagcaaagtggcagctcccaccgctcctgccacacccactcatgctgaactgtgtgtgcaagctccatccctcacacttcatcaccaaacacccttgatgatgacgcctgcttcctgatctggccaggccccagggcccctactgcccacactttcccatcctcagttatcagacagaaaaagttccaagaaaaatccatgctctgactcagagggccctaggtgggcatagcactctgcctcgttcttgccacctccctgccccgtatggccctgtcttcttcaccatacgtggcacccatggcccacctcacctcctcattgtcaaggtctccttgctctgctatggacatggctgggaccagcgtgtctccctccaactctcttcctcacacctcctcatttctcccgtcttccttcttgcctcagagatagaagtggcttaaaactgttcctttcaggaacaactaatcagtggccacagaggtcagaatagcgggtacctggaggacagagggtagagtcttggaaggggcataaggaaacttctggaagtgtagcttgacctgggtgattatcacatgggtatatacagtcatgtatatacatatgtcaagagtcaaaattagccaaacatgctgcctcatgccaccagctactcagaaggttgaagagggaggatcccttgaacccaggaggctgaggctgcagtgagccatgttcatgccattgcactctagcctgggagacagagtgagactctgtctcaaaaaaaagaaagaaagaaaggaaagaaagaaagaaagaaagaaagaaagaaagaaagaaagaaagaaagaaagaaagaaagaaagaaagagttgtcaagctctacacttcatattagtgcactttaagcacttttctgtatatacattacctctcaacttaaaaaacattatcacagagagctctatggacagtagcagaaataaacagcatcaaaaactgaaacttgggtgttggagtcatatgaacccgcactgaaaacctggctctgttttctagctgtgtagctttaggcaagttacttaacctttctgaacctcacttttttcaattgagatgtggatcatgaggattagaaatgctgctttttataaacagtgcttagcacaagggctggatcttgctgggtgctatacacaattgcttttatttttattaatatcagtggcctagggaggacaggaaagtcggagtgacctttcctggatgcaggcaataacgggtggggggcctacagaatttaaagataaaataaaactgatgagaagtcagtctgcttttatgatcactgtgcaatggcagatctaaataatttcagtggtaaaatactttgtcctgaaaataccctttattgatctaagttctaacaattggtgcagtaactgttggggtttaataatgtatatgtaaagcttcaaatcagcacatttttattcttatcctttaataaacatattctacatggaagtcaacttgacttggagaactttaagaatcctatagttgcccccagagcatgtggtctcaggaacacacatcagttgagagtaagctcctcacaactctggaatcttccaagcttgctttgaatgcattcctgtctccaccgtccagcattcatatttctgcatttatttttattattattttgtgtgtgtgacagagtctctctctgtcgcccaggctggagtgcagcggcaagatgtcggttcactgccacctccacctcccgggttcaagcaattctcctgcctcagcctcctgagtacttgggactataggtgtgcacccaccacgtccggctaatttttgtatttttttttttagtagggacgggtttcaccatgttggccaggctggccttgaactcctgatctcaggtggttctcccactttggcctcccaaattacagacgtgagccaccggcccagctgtatttctgtgtttaaacagtagagtgaaatcaactatgaacgcagaatgatgggaaagatgacgataagggtatttcaattttgtcattttacgaaactacttggagttttgatttgtatttacagtttttaaaagagtaaaacagtgtgaactgtgaatggtaatgattttgtttggtaagtgcaaattttaattcatacatgaaaaatatttgttttgtttcatgattattactgaaaataattttgtactatgaaggaagaggggtgttaaaaatgatccactgtggatgtaaattattctaggcatgcttctgactaaaacattagcatttccacaagaatcccaaaaaataaaacaaaatttaaaagatcccttctgtttcttttcctccaagtttccagacccccatctccaccctggccacctcttcctgccataaataatcaaatcccacactttcatcttcaccttccgtttccattgcctcttccgatgggacagcacccgtggggaatctcctccatgctcacaatccccgtcttgccactatatcaagtcacacttcttcctcaccaatcgcccattctggaacctctgctatccagctagatcactttgaggtttggacaactactggtggaggtaatgggggccccagacagcccttgacatcacctcttttatctttgccaaattctacaaacaaagcccatgtctttctgtcccccgcccccatggctggcacatagtagatgtccccaaatcttggtgatgtgaacttgtgtgtctcacccttcacagacatcaccatttcccgttgcacagaaggctccactcataccaggcgctttggctcccagaataagcaggctatcatgctatgtccgacatctaggcgttggtacgtactgttcccttggcctggaacattctgccctctctcaccctctcttttcttggctttctgaaatggcacctccatcagaaagtgtccctcactcttggtctgagcaagggaccttgcctggtattcctgaacttccacctgttttccctctgttttctccctctctgggccttgtcctcaggtcagtgttgtgcctccagctcctgcagaggcgaactcagaggcggccgaatgaaaccaaatggatttggcttgaccccatcatctagcggtgcccagcaagcgctggcacatagtaggtccagcctgcccggactcgcccaccacgggcccccttccagagccgggaggcaggccaagggaggccccttattgccaagagcaaacaggccgcccagggaagttttgctctgggtcacacccacctctgggtggctgccaatctgcctgccagaaaccgcaggctgggccgcggctacccagagtcagggccacggagcttaggagaccttgggtcagctctgcaaaggggttgtttactgaatgcttctggtatctgcagccccgctggggttcggacagggggtctggaatagggcttcacaactacagcagggctaggaccctcttgggctggaaggagctggagaggcctctgcaagctgtcacaggctcttggtgctggcactggctcaggctttcacacacacacacgcgcacacacacacacacacacacacggacaggcacccccttggtggccttcacagtttcaccttcaggtaaatgggctcatcctttgagccatgaggatgggaagcgaagcaaggaatgaaaaagctagtgtgtttgtgtgtgtgtgtgtgtgtgtgtgtgtgtgtgagcgcgcgcgcgcgcgcgcgtgtgtactcgtgcgtgtgcctgtgtgtgcctgggagtgacctcacagctgccggaacataaagactcacaggtccgcctcccaggctcaaagctggctctgcaggggacatgagaggcacaccgaagacccacctcctggccttctccctcctctgcctcctctcaaaggtaaggaggcccgggccctggaatgcactgctgactatttgggtgtggagggggtggggatgtaaaatcgcagccaaggacccccttggcagaattcctccagggccccacattgggcacagtctggcccccatgcctaagcagggcttctctccctggaactcagagctgcctccggccagccctgctgtgtgacctcagatatgtgtcttgccttctctgggcctcagcatcttcccaggtgaagggtatacagtttgtgaggcctctgtgaagaccattcatgatcattcatcaaacttaccaggcaaattgaagaggactttaatgtatcctcattatgaatgggggcactcaagacatgacatgcttggcctaactctgagccagcatttggatggatgcctagctgattggaaggttcattctgcaagggcatcaatgctgttggactcttaggcagtgagtgacccgcccgccctagctagaggggaacaggagacacctctgtggagtaatggccttatccctgaatgctgcatgggacattcaccaaagagcctgtgggacatctaccttgtctaacatgcacaacaatcccataaggaattttcagttaagtgaggctcagaaagggtaagcaacttgcaaccccagttttcagtcaagtgaggctcagaaagggtaagcaacttgcccaaagccacacagcaaagaaaggtcagagcaatagaggagagccatggtggagcccagaatgacatggatgtagggggagaagcactccagtctgtgcctccccaagcccaaactggaccaaggccacagctgctaagccttgtcatcccctcggcaaatgctgagttcccagagccatggaatcggccccaccacaagccacgatctcactgtattttcacgctcctttgaggagcacgggcaggagcttctctccctcaggctccaagtcttcgtgcctgggaagcctgagaaccacgctggcatcctgtcctgctgtttgttcttccaaaggggatgggtagggcatgatgccagtgtgggtggcttgggtagttggaataggggacttggggctctaggagggagaaggggcccaggattatacgagaacaaagtaaagctgtcctagacttgccattagggtgagacttacgggaccattcttccctggtcccaggaagcagggactgcacagaaacacagggacttagtcaccacaacatggaaagccacagcaaccctcagagggagaactgtaagtcttccaggctggccgttggctccggggctcctggctgtggaccggggcaggaggcagacacctggacacaagcaaaatcacattgatcaaggactggccagaacctcatttaatctccatcatcactcagaaacaggttgtctctactccagtttacagaggagaaaactgagcttcacctccaccttccaaagccgtttgtccacatgttcagtcacgtagcaagtcactggcagaacttgaatctcaactcttgcccaaaaaactccatgcccagtactcctgccccagatatcatgagccttgccccccaccaccagatatcacagcaaggccctggggaaactgaggcacaatgggacaacttgagtttgggccttggatgtcaacttgaacttggatgtcaatcctgattctgtctcttactggctgtgttactacacggtttgagctccagttttctcatctttaaaatgggcataatgatggcacctcacattggaggggtaaatgagacaacagcacttggcacatgacatacatatggtatcacatgagataattgtacactagaatagttgatatcattaatagcctctcctgggtatcggggcctacagagtcctgccccctgacaagcatggccagtagaggggtccacagtgggagccaaggtgcacagctgctggtctatttcctggcactcctgttttcaggtgggagggacctgagagtcatttctgacagtcctccctccattgcccacaagccaagggagctgaacctctgacttagaagggaacccaaaagcctagaccgtttctatgtgaatcacctgtggatttatgaaaatgcagattcgggctgggcgtggtggctcatgcctgtaatcccagcactttgggaggccgaggtgggtggatcatgaggtcaggagtttgagaccagcctggccagcatggtgaaaccccgtctctactaaaaatacaaaaaattagctgggcatggtggcatgcacctgtaatcctagctacttgggaggctgaggcctcccaagaattgcttgaacctgggaggcgaaggttgcagtgagtcgagatcgtgccactgcactccagcctaggtgacagagcaagactccatctcaaaaaagaaaaaaaaaaaaaagaaagaaaaagaaaagaaaatgcagattcggatttattatataaaaattcagcttcggatttatagaggggctccagatgctgcctctctgacaagctcctagatgacgctgctgctgctagttcagaccacaccttgaggggcgaggctaggccatcgtctctagaatctgaacagcctgcagcgatgggatccactcccttgtgaggcagccagacacctagctccgtgtgtccatctgctactcagtgctgtctcagtgggggctgtgatcgcctcctactttgtggcccccaccagaggctggtcagccagtttgcaatggctcctagtggccggcgtgggagttgccgggaactgaaagcaggtttgcaggattgtgggtagtgggggcactgggcggggcagagggtgaggcagagcaaaggggtcattgcctgctttggggctgcacaggagatatgaggtcattaattccatcattataaactgcaagcctccattcctctagatgaaaccctcatcccctaaggatcctactaaactcaaacttggccccccaaagatggggccactggaagcatcttgaattatacttccttcttggtccccaccttcaaatgggcagacagggagctcacggcacctgctgtatgctttggttgtttctctgatgtgggtggcgagggtcaggcaggccacatgggctgataccctgatcctgtctctggggagtgggtccctggcttacggacacagtctacccccatcccgtgtccctgagtcctcacttgggaagcaggaccggggacgctcccagccctgaatcgaacacactgacgtgtgctaagttcctgtccctctctggagctcagtttccccatccgtacctggcagggggaggaggttagactggggcagaggtgctgaaaacctagctgagcttcagaagccactggacagcttattaaaaataaagattccaggtccctgactctgggacttctgattttgtaagccccagagtgggttgggggtctgtattttcccaagtctcctggctgatgtgatgtacctccagagctgggacacatgctgaatggatcgaaaggccaaaaacatccatgatatggttcaatttattcagtcctaagataagtatccgtatgctggaaaatgtaccagaccctaccattttcatccttgacttgttgcttttgcctttctgtaagctcccagagggctggggctgagccctctgccaccattaacaacaaggatcatcaaagctaagtgcagtgagcgcctactgcatgccaggccctgtgctgagggtttgctgtgcagcatttcatgtactcctcagagcaatcctctgagttagatactttgaggaaactgaggctcagaatgcttaagtaacttcctcaaggtcactcagctaataaggggcagaattagaactggaagtctagccaggtgcagtggctcatgcctataatcccagcactttgggaggccgaggcgggcggattgcctgagctcaggatttcaagaccagcctgggtaacatggtgaaaccccatctctattaaaaatacaaaaattgccaggcatggtggtgggcgcctgtagtcccagctactcgggaggctgaggcacgagagtcgcttgaacccaggaggtggaggttgaagtgaggctgggatcgcgccactgcactccagcctgggcaacagagccagactctgactccaaaaataaaaataaaaaataaagaactggaactctagtccagagtccttgcccataactacatgccatactgcctcttagggcatgttgtgggactactggcctttgaggccaggtctgcatggctctgaggctaaggtgtggacaccacactacccagcctggcagagaagtggctggttgtgagggtctcactgcccacctcgaaagcccgtggctgagtgaggtctctgtctcttcaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggccggggggccctgtgcctctgtaagcaggtttgcaggactgagtgggggcgggtgtgagcgggaggtcaaggccgtggtgtcctggatcaaagtgcagccctcctctctctacctccttgggtgctcacttcaggtatcccatccattccagctgaacttggtgtcccaaagcccactccccactccctcctctcccttcttggcctctgcttaaaccatctcactaccccaataacctttccccatccctacctgtccaaatcattgccaactttcaaagccaagttcaaacagcttctcccctgagaagcccccccagattcttcaaaccagatgccaccactcccttctcaggatccttacaacactttggggaaaataaaagtgcaaccttttagggcataatatgtgtccagaactgtgctaagcacttactacacaagtcacatcatcctcacaataaccctatgatgggaagtactttcagacctattttatgaatgaggaaacaggttcaccagcattaagggacatgcttcatgtcacacggcacgggaccagatccaacgggctctaaggaacagtttattctgtcttctcccatagtgggggccctcggagcactgctgggatcctgggtttgccatgtattcagcagtcacccgagcatgtgacattcctcaccactcttctaggccttggtattctctgatgcttcggggcagggctttgcaagctggctccagtgactgggtgccagagaattagttgttgtgggagggctgtcctgtgcatggtaagacttctagcagcatccccgaactccacccactgtatgccagcagcactccccatcccccaagtcatgacagtctgtcttcagacagtgccaaatttccccagggggcaaaatctccagttgggaaccatcactttagagaaatgcaaagaggcaagagattgttcttcttttttcttttttaataataagccttgtagaacaatttgcctctttcatctatgtgcatgtcacacttttataaaaataagaacgaaagagagagagagagaagctcatgaatcattgataatgaattcatctgtaggaaaagccttgttaaaaaacaacaggccaggcacagtgactcatgcctataatcctatcagtttgggagactgaggcgggacgaccacttgagcccaggagttctagtccagccttggcaacatagtaagatcctctctctatcaaaaaaaaaaaaaaaaaattagccgggtgtggtggcacatgcctgtggtcccagctacttgagaggctgaggtgagaggctcgcttgagcctgggtgtttgaggctgcagtgagccatggttgcgccactacattccagcccgggcaacagaccaaaccctatctccaaaaaaaaaaaaaaaaaaaaaaaaaagtaataactccatgtgaaatgctttatttacaagtactgtaaggataaggagggtgattcgttacactgactgagggatgattgcttatgaaaatgtatctgaagaacaattgagataagtaacacttcgcttacaaagctgttatttacatttgctgtgacacgtgtaaacagcacccacagagtttattttacacttgcacagcccttaccacgtgtaagacactgagggtttcacaaatataaactcatttaatctcacaaccacatgaggtaggtacccttctcttataaatggaaaaaaggggtacagagaggctaagcaacttgcccaaggtcacacagctcataagcggcagagctgagatttgaactcagggagctggctccacaagctccattgctcaactgcctgacatgcagcagttgattagtacataggctgtgattgttaataactgtattaagggatttttcttattccatcttaattcagacttcaaacacctgcaggccaaaggcgtacttgggtccctggtccttcctgcaacttcccaccttggtctgtcaacatgatgggtgctcaacagtgtttaatgatttaaactgaatttagaggccgggaactggtgaaccccaaagagtccagctaagacatcacaaaggctcagtctagggctttgcagggaacatactgccaaaaacctctcccatcacttactcgttgaacgctcttctctaagggccaactctgagctgtgagatgtgctgcagattcaccatcgtgataacagcgcatccaatgccgggatcctgatcttccgccccccagaacggcctccccagtctgttgagagcacctccatccttctcatggctcagactcaagacctgggagtcgttctagaggtctctctatctctctctcttttttttttttttttttttgagatggagtctcactctttcacccaggctggtgtgcagtggcaggatctcagctcactgtaaccccatctcttgcgttcaagcgattctcacgcctcagcctcccaagtagctgggattacagacacataccaccatgcctcgctaatttttgtattttagtatttcagtagagacggggtttcaccatgttggccaggctggtctggaactcctgacctcaagtgatccacccgcctcggcctccctaagtgctgggattataggtatgagccaccacagccggtctagacatctctcttttctcacctcccacataccacccaccagcaaattcatcgtgtatttccagcatccgacactcccatcccttctggtctgagccccgtcatcattggcctggattttgcagtagccccataatcatctccctccttctgtcgttgcccctggtctattcacaacacagcagtcagagagctcctgggaagtcataagccagatcacctccctcctctgccccaagccttctggtggcttcccatctcagaggaaaagccaaagtccccacagtggcctacaaggccccaacaggatcctgttcatgcttcctctctgacctcctctcctcctgctctctgctccagccacattggccccttgctgttccttaaataccccaggcacactcgtgcctcagggcctttgcactggctgttccctctaccagcattatttctcagcaaggccttccctgctggaggattagatgagctaggggacttacagcattttgccccaagcctggcacatagcagatgctacgtggaagcataaccctctcctgtttattgagcatctgctatgtgccaggcttggggcaaaatgctgtaagtcccctagctcatctaatcccccagcagccctgtgagccgggtaccaaggctcagagaggcaaaataacttgccccaggccccacaagtgggagccagagttggaacctaagtatgtgtggttttggttctgaaacccctgtgtgtgtacagacctactggaaggttttctcagaagatctgggagaacttgtttgctaatgagtcctttccccagacgtagctcagtggccacccaggtctcacacacacgctgtttcccgtctgcacttcctgagcagctcacacgcttcaccagcgctcttacttcattctgtcttggagatgatgccctcacacccgtccccctttcccaagcccatgagtccctcaaggcaggaactgtcctctttctgtctgggagcacagtggttggcacacaggcgggaaacagtaaatatctctggaatgataaggagtagggctattttatcagggtctctcatgtgccaaggcttatgccagctattcactgaaggggcattcctacagtactgtgtgtcgcacctaggctctgagcccaccggagggtgcagagacgcacactggccgccccagccctcaaggagttcatgtccagtggaggaagtggcaataacacccatatcttgagggcttcattgaaagagtgttccctgagcacctaggccatgcctagcactgtgtgctagagggtacggacatgtcatcccatggaacctgaagttacgattactgagctcatcattgctgtagttcaggccactcagagaagttaagtaacttactcaaagacacacagccagcaagttaagccctgacctgacagtgatgacagcacaagtggacaacgactttgttgcatgaaatctcagcgtgtatagaatacttaaactttattaatatatagtaactatactaatgataataacagagtagctaggacctatggaaggtctcttttatgttgtgatcattacgcctatcattccgagtagtctctaccaccctggaaaataagtaccattatatcccagcttgcaaatgtggaaactgaggcaagaagaagtgaaatcacttggcccaggttcacagctaagaaagggcagagtttggggggtcaatccaggcctgtcttcttgcaatccctgtgccgggatccagggtgccccagcaggctggtggagggctggggagaggtgcatatcctgggctggagccctgggcagggcccagctactgtgaggcagctgcctcaggcagcgggatctgggcagctctgcagagaaggctgtgccgctttgcgggtcaccgatgggggtgcggtttttcctccgcagtggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggtgagcgcagcggtggtccaggtcagggcaggactgcctgggggcgccaagggccacctagggggtggggtggggggcggcttcctgggtaccaggacccagggacacatcagaagctgggaggggcggaggctgaggagggagataagaaagaggagtggagggccgggcgctgtggttcacccttgtaatcccagtacgttgggaggccaagacgggcggatcacctgaggttaggaattcgaaaccagcctggctgacataggaaaaccccgtctctactaaaaattcaaaaattagcctagcatggtggcgggcatctgtagtcccagctacttgggaggctgaggcaggagaatcgcttgaacccgggaggcagaggttgcagtgagcccagatcacaccactgcactccagcctggccgacaagcacgaaacttcatctcaaaaagaggaaaaaagaaagaggagtggagggtcaccaggcctccctctttaaaaccaataaacaaaaagccactgcctttgagatgtgtaatttaaaaccataaataattaaaaataaaaactgggtgacagagccgggagaggaaaggtgggttagggtatgtgaaccaaattctcacatttcagagatataatagagctaagctcttagaatatataatattatcgtatttataatatattgatacatattaatatatttagtaatttattattatttgggcttactaaaaaaggaactcaaaactgaacgaggcaaagtggctgctctggaatgtgggccgggggtgggctagagatggagaaaagacagttacctcccaccgtcccactataaatcttcaattttagagatttttgttgttgctgtgttgctttttgaaaattatcacatgaatgtgactttctaaaaaaggcaactgaaaagaggaggattgatttcataaatgctgctgccacccacaagaggtagtcacgtgttatgggtcaggtgcacggcatctgcaacagccccgccatcccctttttgctgtgtgactctgagaaagttgcttaacttctctgtgtctcagtttctccagctgtaaaatggggacaataagagcatccacttcatagcgttgtgagaactacttgagtttgttcaagttaagcagctgtagcagtgcctggcacatggtactatatcagaggtagccgttattatccctgtgatggaatatgatatatccatttaaatacataggaaaacaccagtgagttcaccttatggataaaagcaggataagaaggtgtatttccaactcgatctcaactaagtgtgtccctatgcacgtatacaggtatatctacacatacacatgcatacacagcacacacatgtgggtagaaatcagggtttctcaacgtcagcactagtgacaattggggcaagtaattatttgttgggggggttttcctgtgcactgcagggtgcttagcagcattcctgacttctactcactagataccagtagcatccccccagttgtgatcaccaaaactgtctccagatattgccaaacctttcctgggaggcaaaattaccctagttgaggacttctagtgtaagactagaaggaaggacaccaaaatactcacagagggagacttggagcagagaaaaagctagaccatggtgaacctgccatcttgttcctggcacaagaatcctggaatctttagcatccttgccactgggccaaagcaccactccacacaggctgggcaccccctgcctgtaaaatgctgtttatccaaagagacgagaaaaccatggttcactgagggaccatcgtgaccaacacactctggttgccaaataactaatatttatggaaatcttacaagtaccaggtactgtgctaggcacttcatgcccattattttattcaatgccatccactgttaagaaatttacataacaagaaactgagatgcagagaggctgagccatttgaccaagattgccgtggccgctggcaggtgggttgattgagctgctgagccctggctgctcagtgctaactcttgttctttcccccctaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtgatcttgtgtgtcaggcctgtgttttctgagaaagccctcccattatccggggcagaattcaggggcagagttctctgtgaacctcacaaggtgaaatcacatggtcttaaagaaagccagaagacaggccttcaagtgatccaagaaacccaattcatattaataataattaacttttttatttatttatttttttgagatggagttttgctcttgttgcccaggctggagctggagtacaatagcacgatctcgactcactgcagcctcccgggttcaagtgattctcctgcctcaagactcctgagtagctgggattataggcgcatgccaccatgctcggctttttttttttttttaaatatatttttagtagagatggggtttagccatgatggtcaggctggtctcgaactcctgacctcaagtgatccgcccgccgcctcggcctcccaaagtgctgggattacaggcgtgagctactgcgcccagccaataattaacattgcttgagcgcctgctatgtgctaggcactagcactttatacagaccagtgcttcccagcgtttttgaccagagaagagcagggagaatgaaggctgcctcccagggactggggagcatagcctgaaatcaactaacccaagggtgaaattgttcgaagtctcatgttttattgtttacaaacaaaacaaaacaaaaaacaaaaacaaaaaaaaacacccaacaccaaatacatatattttacattttcctccatggtctacctgtgtttgtttaaaaagtaaaactgtatttccattaggatccaagcaggaaattagaaaacactcttggtatttaaacagggatttcttcttattaaactaattttattaaggtataatttacccatagttaaatatacagattttaagcatatggtttaacgagtcttcataaacgtacacgctcatgtaaccaactcctcaatcaaggtataaaacattttcatcatctcagggagttccctctggctctgttccagttatccccctgctccccaaggcaaccactgctctgatttctatcaccatagatgagctttcgtgttcttgaacttctcattaatacaaccatacagcaggtactctataatgaatgacgtctttcactcaacataataaaacaaaaggaatttaatgagaggacttagtcacccatctgagaggccaagtaggggaccgtgtgatgcaagaggagaaattcaacaccagaccagccctcggggcggaggggcagagggagggcagagcccagagctggcaccagcaggcagaggaagaggacctggcaaggctgtctgctgggagctgcagccgctaaggagacacagcctcgcagacctaacaaaaagtagatggaggtggggagacctgccctggcttctgcctgctgctatcccccagtttccagttatgcctcccatgagtcgaacctgctgggaaggtggaagagaggggagcctgggagatgcaggacaaggaagggcaggagggttctgagaatgagggcaattcccagacacagtgtttgtaaattacccaccccaggtacggttgctggtcacagaggcccctgctgcccagcccccaacacttatctcaggtatcaccccctccagaaaccttagtttgagaatcacatgctgagtttgagccatgtaaccttcacagagcccctgcatggcaaatataactaactccagctcagggataaggaaacacccgggaaagcgagctgtctaaaagctggtctgcagctggggtgggatgctagtccaacctgagtttatctgactcttgagaatggctgttggtctctcacagattgagaatttccatgggtctggttctgcaaggataaaccctaaacacatttccaggcaaaattctgataacatcccccaaaacagggagaacacggacaagaatgaggaatgtgcaccgagggactcccatacataaggctctctctgccacgcactctgtccacaccactgcacgtcatccttgggacattcctaaaggaaagtgccactaatactccctgtttagagatgagtaaactgagacccagagtgattaacaagttaccctggagtcgtggagctgggactcaggcccatgacctcacagctgagccgccactgtgcagtggtagagtgagtgggctcagccaacctgcccaggtgtgcatcctggctctgctatttcctagtgctgtcatcttaggcaaagtacttaacctccttgtgcctcagtttccccttctttaaaatggggataatggcaatactcaacacagaggattgttgaaagtgttacgtgatttacaaaaaaacttagggccgggcgcggtggctcacacctgtaatcccagcactttgggaggccaagacgggcagatcacttgaggtcaggagttcgagaccagcctggccaacacatcaaaaccccgtctctactaaaaatacaaaaattaactgggtgtgatagcacacacctgtaatcccagctactcaggaggctgaggcacgagaattgcttgaaccggggagacagaggttgtagtgagccgagatcgcaccactgcactccagcctggtggacagagcaagactctgtctcattaaataaataaataaataaataaataaatattggaggccgaaagattgagggtcatgatcaactcagtataccactggaagctatatgagtaagcagcagactatttctcataaatgcagaatgttggcaaactgacaaactgtttctgccatccagaaggaatgctgagggcagtcacgctccaagcatagtgtttcttgtgattaggcctaattgaaacctgttagtaacaatatgaatctgtgatcaatcaaccagctaaccagtcattacctcctcctccctgctcattctacccaataaataggaagggctgtggaagctcagggactgcctttgctcactagaagcagggagttctcttcttcttcccctggccctttcctttacaacagtttcttttgtcttaagttttcatttctacattcgtcccctcgttcagtcctgtaatgaagtctcaggcagtaacagtagtaactgctgtaatgacggcctcaagtagtaacagtaataactgtcatagtgacagtctcaagtagtaattgtggtagtctgcaacaaaataaaataaaataaaataaattttagcaaccgttatcctaactcttggcgctttagttttttgatctgtaaaatgggaataaatagtagtgcccaccccacaggatggctgtataaagtgagtacccggctgtgtgcagtggcgagcacgcctgtaatcccagcactttgggaggccgaggcgggcggatcacctgaagtcgggagttcgagaccagcctggccaacaaggtgaaaccccatctctactaaaaatacaaaaattagccaggcgtggtggcacgcacctgtaatcccagctacttggaaggctgaggcatgagaatcacttgaacccaggaggtggaggttgcagtgagccaagatcatgccactgcactccagtctgggcaacagagcaagactctgccaaaaaaaaaaaaaatagtgagtatccactccgcaggggtattgtgagtattaggaaggtaattcctccatgttcttcaactgaagctattattatcatcctgcctgcaattcttggcaagtgttgtgaaggcaaagactgggaatcctcttgtttgtggagaagaggaaacgtgtcgggggcaaagtcacaggggcaaaccaggtttaccctctctgaagctctcacggccacaggtgcccaggcctggccattcctccatgggaagcttctgcactcacttcctcagtgctggcctgggtctgcggggcaagctgagtgtcccggggcagaatgctttctggagaggactccgctaccagctgtggctgaaggacctggcacagggcctgttcctggggcccttggcacaccatcctcctccagccgagagccgtaaggaagaagtttccctagtgaagggcatcaacaggccccaggaggtcctcctgcctgccaggacacccgtggtcctccccatcctaactagttacaattaaaatgaatctagcaaacacagacagccaggccctcccacgccctgctctgggatccaggaacaacgacggcgcccaggggagcccacacacttaaggggagcagcttacagtctcactgtttattgagcagctactgtgttcttgatgcttttgtaaaccagaaagtgtctgagacaggtctcaatcagtttagacatttatttttccaaggttaaggacacgcccagtagagaggtctgtgcctttctctaaagatgactttgagggcttcagtatttaaaggggaaagcaggctggaggggaaagaaggagggtctggaaatccacatattgcaagagaaaaagagcaggtagggaaattatgtattcgattatgtattcgtctcacgctctgtaactttacataagataaggtgaacacagagtggctactcgtggagatacctggccttttatctgtggctctctgcttacgaacaaaggaaaggcagcttgttgcatgactcaactttcagcttagttttttccttttggcagagtgaattggggttttcattttcctttcacactttctataccttctcttattgaaaatgaggtggttgctgtgatctgcattttacagatgagaagctgaggcttgaagaatagaatcaccactcacaatccaggatgggaagtcagaaccagctgaaccagcggctagcccagcctctctccctctctctctgttcctctctctttcttctatctctctatgtttctctctctcaccgtttctctcttctgtctctctctctctcatcctctctcctcctctctttccattttgtttctcttttccttggctttttcttctttcttgaatttttaatgaagtataaaaagtatacaaggccaggcacggtggctcatgcctgtaatcccagtactttgggaggctgaggcgggtggatcgcgtgagctcaggagttcgagaccagcctgggtaacgtagtgaaaccccctctacaaaaaatacaaaaatcagccgggcatggtggcacatgcccgtagtccaagctacactggaggctgaggtgggaggatggcttgagcccaggaggcggaggttgcagtgagccgagattgcatcactgcttctagcctgggtgacaagagtgagaccctgtctcagaaaaaacaaaacaaacaaacaaacaaaaagtatacaaataaaagtgttcagttagtccagttttcacaaatgagcacacccatgcaatcagtacctgggtcaacagcaggaccatgcattgcctgcacctccaaaatccaccttggtctccctctcttcactacccacaagataatcactatcctgacttctaacagatagatccattgtacctgaccagaggcagcagccatcacctggagacttgttagaaatgccccatcccagacctacagaagctctgggagtagggcccagaaatctattttaacaaacctcccatctcgttaaaatcagacacagctccagctcgggggaggacagcagtgatgtgctgctgcctccttgtggcatttccatgcatgaacagccgagaggccacctgccaggaggaggctgtcttcaaggggcaactccaacagcctccctgggaggtacccctcgactttctgcctaggaaaggggaggcaaccaatggccaccatgtgtcaggtgctaacgaaaaggccacctgcctctccatggctaaaatgtggtctagggtctgaggtgcattctcagccatctgattctcaagaattcatcttttttcacttccactgacatgaattatgacatcagggagaacccaagggcagaagtaggggccaagtcctcttcatcacctccaggttggctgacaaacttggttgcaagtggccccatcacactggcctggtctttatctatggcccctttgtcagaggcgttagaccagagcaactccattttgagtaggggctgggtaaaataaggctgagtcctactgggctgcattgccagacgatgaggcattctaagtcacaggatgagatgggaggtcggcacaagatacagatcataaagaccttgttgataaaacaggctgcagaagctggccaaaacccaccaaaaccaagatggcgacgagagtgacctctggtagtcctcactgccacactcctaccagcgccatgagagtttacaaatgccatgccaatgtcaggaagttacactctatggtctaaaaaggggacacatgaataatccacctcttgtttagcatgtcatcaagaaataaccttaaaaatgggcaaccggcagccctgagggctcttctgtctatggagtagccattctttattcctttactttcttaataaacttgctttctctttgtggacttgccttaaattctttcttgcaggagatccaagaacactctcttggggtctggatcaggacccctttctggtcacacctccactgcccaatgccccctcaccactggctttcatgaaaaaggttttaacgtcttcgctgggccaggtcttttcatccagtctctgttggatggccaataacctaacgtgaacctcttcagcagcttctcccctgccctgaagccagcaggggtgggacacaggtgactgacttgactccctctaccctctcaaccccctcactaccactcacctcaaggacacaccctccaggtccactaacccccctgcctctctcagtctctgagacatctcactgcagtcccactcccctgccttcctctcttgacccctgctctgtggccatctgactaaaacccagagttggagaacctggtggtatcaccgcttactccagatggctgatgatctttatgttctggatcgggtctcaatccagaccccaagagagggttcttggagctcgcacaagaaataactcagggtgagtccataaagtgaaagtgagtttattaagaaagtaaaggaataaagaatggctactctaagtcacaggattctaagtcacaggatgagataggaggtcagcacaagatacagatcataaagaccttgtggtaagacaggttgcaatcaagaagtcggctaaatcagaacctggtggcagaaactggtgctgcgctgcctactccagatggctgatgtggcatctgtggaatgcaaagtctccctgagtcttttccccacgtcaggaagattgcttaagtatcagactgcagttgccagaataaatctaaatttattttaaatgttcatgtcaacagtcatatttgtaatgtttttttccttaaaaaacatgttgtacatatggatgttcgtcattgctatttatacctttatgcctgtctttattagctagggtaaaccagatcccagtaataaataaacccgaaatccagtggcataccaagggaccaggggaggtggtagtgttacaggaagggggtcccagtccagaccccaagagagggatctggatcttggaactcgcgtaagaaagaactcaaggcgagtccataaagtgaaagtgaatttattaagaaagcaaaggaataatgctccatagacagagcagccccgagggctgctggttgcctatttttatggttatttcttgatgatatgctcaacaagggatagattattaatgcctcccctttttagaccatatagggtaacttcctgacgttgccatggcatttgtaaactctcatggcgctggtgagagtctagcagtgaggacgaccagcggtcactctcgaggccattttgattttggtgggttttagccggcttctttattgcaacctgttttatcagcaaggtctttacgacttgtatcttgtgccaacgtcctatctcatcctgtgacttagaatgccttaaccatctgagaatgaagcccagcaggtctcagccttattttacccagcccctattcaagatggaatcgctctggttcaaatgcttctaacagtgggagttttctccctggtgagaaggaatattttaacactaatgtttagaattgctggcatgtggtgataataaaaagcagattgacttttagaccttttcattactgttttaaaattctgtacagacaatgtacccctttatcacctgcatccacttccactaccaccagcgccattggaacgtcactgccaaaatgcttactagccaaagcacaaagtctatgtgtgttacgtaacattccctatgggtgcttctgcttggtgggctcccctacatggtgatacagggactcaggatccttcgtctagggctcctccttcctctctccttctcccaatcatctgcatccagtaaggcctgactaggtcagggaggaagcccagacaatcaattcatggagagccggagccaggaagttgcacacagaacttctgctcttgtctcattggttaaaactcagtcacatggtcacacccaactgcaagggaggctgggaaatgtagtctatctacatttcatgtgctatcacaaacatccatcagtctttgccacaatgtcttaaatatttcacaataaagaaatgtcaaatgtttgtgttagacaagaatgtggataaactaccttctttctctagtataggaattttaccatgggacagatagtcatggttcaaagtcatgaaacaaatgatctcaaattttatactgtcccagtgaccagaatgctgagttcacagagctttccactgcctctttctcctactcagatgatttcccttctatctgagcacatgcctagactacatttcccagtctcctttgcagctaggtgtggccatgtgactcaatctttaccaataaaatatgaagggaagtgacatgtgccacttcctgacctgagccttacaagtttgtgtgcctgcttcgagttctttccccttcccattggctgcaaccctctgtgccccagcttccactgtgcagacaggaatagtatcctggggcagtgcagtgattctcaaacttgcagaatcactcggagggcctgtaaagacacagatggctgggccccacacctaaagttcctgattcgctaggcccaggatagggctggagaattgacatttctaacaagttcccaggtgctgttgaagctgccagtccaaggaccactctggaaaccactgtcctaaggaatgatggggtgcactatgaagaaacctgggtctctgagtggccccctggatcatagctgccttgacaacttggcagcgcagttgaaaaagaagtaaacttttgtcttctttaagtcactgcactgctgggcatctttgttacagcagcttaacctttaaccacactaacagagttgggattctgtcacttgcaaccaagagtcctgaccaatacagactcgaagcttaacttcagtaagttccgccactaagagagtttgcttcttttttcctgcttatcccaaacccgcagttttttcatcttaccttagtattgaccaggattccggaaggagatatgcacatgcaccaagccctaggaaggacctggaaggtggagaatattccactatgctacaatcttttcaaacattaacattattattatctcaactacttgcctgagtcccttgaacacaggcccagctctgaaatgtagttgccatggggtctggaaacagcccagacacccactcctcattggtgggtacctcttgtgctgttttcctggctctaggtgaacattcacaccgtgcaggtaaagaagggtgcaaatgcaggttatggggactcgtgtggctcaagctctaccttggaatgtgtggctcagagccctggggatcaagcttggcagtgggagaggaggtggggggaaggttccatggccctgagagaagaggactcacaacatcttcagggctctgtttcctgaggttaatgggccctcagcaaagcacttagagggtgtttctgtgtttctcttgcctactcctctgccatgaataggtgggccacaatggggtccatgtagaatagtgtttttcctatggtcatttagcaagtcttggacagagtccatttgagaaccaggcctcctgtctcccagcccagggatttaaaaaattatcccatcctagtttggaaagcagccatgtcccgaactgcaatatgggctctggcctttggaggaccagagagagcctagcaatggcctcttccacgtcctgaagaaagtactgcagggggtgggcacagtgactcacgcctgtaattccagcactttgggaggctgaggaggttggattgcttgagcttaggagttcgagaccagcctgggcaacatggcgaaaccccatctctacaaacaatacaaaaattagccaggcatgatggcttgtgcctgtagtcccagctacttggggggctgaggtgggaggatagcttgagcccaggaggcagaggttgcagagccaagatcgcaccattgcactccagcgtaggtgacagagtgagacccctgtctccaaaaaaaaaaaaaaaaaaaaaaaaaaaaagttcctgcaggcatgatatggtggtatttgacacctcttgtccgtccttggctttggggctttagctgtaaatctgagacaataggaaaagtcccatttaagagtctcttacatgtgtgtcatttaacttaatcctcatgacagccttatatgggaagtgtattaaagagggtaatgctagttgctatagcgaacagcccccaagatctagtggcttaacacaatagcagtttatctcttacctaatattgcaaggcaggtgtttgttcctggttggagagatttcctttacgtggtgatccgggtgacttccatgttgcagctttgccatcctgcagggctttgggttctctgcatctagacagacagggatggagaagctcacctacttcctcgaggccctgcctggaagtgacactcaccactcctgctcacattccattggtggagactagtcacatggtcacacctagatgccaaggatgctgggaaatgtagtctccagtggggcacatgtcttccagagacaattccacactatggagtcttttccagagttagtgcacaaagtcctctttactaatctgtttaaccagcttgccaggctaaccagcgctctccatgctctctgaatgcaacgctactgccccaggcatactgaatgcttatggctagtaagccattccctaggcccctggtcgcctttggctcttggccgtagaagagcatgcttgccaacagtctgctgggtctgttcccaaatcagtttgcacacagcacacttaatattgtaacaatgtaactgaattagatattccataaactgatgaaatatgagtgcaaaaggaagagatttgtttttctgaaaactgaatgaagactggttgctaaaaagaatactgtcaaattaggtgtggaagaaacaactacaaaacatctagaaaaaaaaaaacccacaagaatctagagggattctgcactccagttgccatacaaatgtctgcaggtccttgccccactttaaagaaaccagaattggccagggacggtggctcatgcctgcaatcccagcactttgagaggaattacaggtatgagccactgtgcccagcccctgcaggactttcttcaggacattataccagctttccttccctcaaaagcctccttagcctatataaagcgaagattatgaataaatgttaagggcaggtttctggaaccagacagcctgtatttgaatcaagcagtcctcctgcctcagactctcaagtatctgggacaataggctcacaccatggcacctggcttgaaatttcaacttaattcaattttaattaatttaactataaatggccacatatggttactggctaaggcattgggtagggaagctctgtgttacactaacattagcacatgtatttcttcacgtctcaggctctttctttgccttgactctttctagcccatgatgtcttgtgaaatgcaagtcctgcccccgttgattcagacagacagctcttgattccaacatattatgctgactgggaaagggaggggtggtccttggcaggaggaaaagggacaggcctctgtctgtagcaactgggctcaaattgccatatggcagcaactgccacctgtaacactgccatgctaagctcctcactggcagggaagggctgctgtcaagagcaagagctcagcagctggttccccctctccttggaattgtgactttgaaaaaaatctctgcatacttctgagcctcaatttccccatctatagggtggaattaacaatgcctactgttgttctgaggattaaatgaagtgaggcctgctttgtgcttggatcatactaactactcaatcaatgttctcgtttactctaactctcagagtcaccttccactcagaccaaataaacagcaggggaaaaaatagggtgggatggacagagagaaaatgttcttttaaaaagtgttttattggccaggcacagtggctcacacctgtaatcccagcactttgggaggccaaggagggtggatcacctgaagtcaggtgtttgagatcagcctggccaacatggtgaaaccccatctctactcacaatacaaaaaaaattagctgtgcatggtggtgtgtgcctgtagtcccagctactcgggaggctgaggcaggagaatcgcttgaatccaggaggctggggttacagtgagccgagatcgtgccattgcactccagcctgggcaacaagaacaaaactccatctcaaaaaaaaaaaaaaaagtgttttattgtgaaaattctcaaatatacatgaaagtagagagaatggtttagcaaacctctatactcctatcacttagattttcaaatctaaaacaaaccacagtaaaggtttttttgttttgtttctgtttgttgaggcagggtctcacgctgtcacccaggctgaagtgcagtggctgatggaccgacctccccaggctcaggtgatgtgatcacggctcactgaagcctcgacctcccaggctcaagtaatcctcccacctcagcctcccgagtagctgggactataggtgtgcaccaccatgccagctaatttttttgtattttttgtagagacaaggtttcgtcatgtgacccaagctggtcttgaattcctgggttcaagtgatctacccacctcagcctctcaaagtgctgggattacaggcatgagccaccacactcagcccagcgtaagggttttaataactccattaactcagagatatggatcctcatgaggctgaagaacaaactctcagtggctccaaggaaatggtcacaaacacatgttaggacctctctgagcagccctgcctaaaacccgttagagacagagtcttgttcagacaattgtcatttgtcccccaaataatatcctcatcggcctgggagcagtggtttcccccactgggtgtggctatgtgtttttctggtgatactcaagattccatctctctgggtcccccaaaccgtatgttttgtctttcagtgcccagaaaattatgagagaccccaaactcctaccagtaacgttgcttaaattagcaagagacagcttttaatttcttgtaacccagatccctaaatgacagtcaggctacagaaaagccacagcggccacctctaaggagctggcacctactgttccctgaggttaaaataatccattctttcaggagagagacaagagagagatgttattagggaacgtgccagatcttctggctttctggaaaattactgggctatagtctaactattagaaatcaatcccttaagatcccagtagccctggggaataggcagtgtggaaaagggcaaagaagaaattaattgggtggaggacagtactaacatttgctgggcatactctgtgctgagcagttcttcatacactccatttaatcctcacgggaacactgtcaggcagatattcctagccccaggtcacagacaaggaaactgaagctcagagaggtgaagttacttgcccaagacacaaccaaggtctggctaactctaacacccatgttcttctttgccactgccctaccctgtgtggccttaggtgagtctctctctctccttctgagcatcagtttcctctccctgagatgggaatggcttgcctggctcacagaggctttggaaggatctagactcctaagtgcttagaagcatgcccagcacccagcctgggactgggattgccttttttgtcatcctcaaagctgacaaccttggagctctgaaagaagaaaatccaaggccccgctgagggacgcgggtgtgcctctggggcgatgggacagaggaaaatcactgggttccctcaggtctccaaaggaggaaggaggagaggaggcagagggaggtaagctgaagggggaggtgcctcgggtgttgctgtttttggtgactgctcagctgacagctttccaacctgagaaacacacatacacaaagtctaacctcctctggcttaaaatagagccactgaaccaaaaatgccaagcacagggcagagtcatctgcctgacggagccagacagctcccccatggccccagtaacatccacccccagtgggcacacctgaccaagcgcctctcagctgcgcatcatggggccctcacaacagtgggcaagcaaagccagccacggatcctcggccccatcccggagacaaggcaagtgagagccagagaggcgatgggagggggataaagccagcagcatctggcctgacaaggatcatgacctggggaaccggacagccctgagttcaatcctggctcagccacagcctggctgggaggacttggcaggttaagtatctcttggcaggttaagtgcctctgtgtcctgggctgtaaggtgagagtcctgtgagtgatgtctgtgattatgcctcgcacaggcagagtgtttggccctgtccctgcttctggaaaaagaattttcgacatctgcacacagacagttgtgaaaaaggaggagaagcagctactggctaaggggcacctggatagtgacacaaaacagcttctataatcctctacatggtcctatggggtgagggtcattactacccccgtttctcagatgagaaaaccaaggcacagggaagtacaagtgttctgtttatggacacctagtggtatggtttggctctgtgtttccacccaaattgcatctccaattgtaatccctgcgtgttgaaggaaggacttggtaggaagtgattgacttatggaggcagttttccccatgctgttctcgtgatggtgagtgagttctcacgagatctgatggtttaaaagtgtttggcagtccccctcctctctctctctcccgctgctatgtaagacatagcttgcttccctttggtctctgccatgattgtaagtttcctgaggcctcctcaggcatgtggaactgtgagtcaatgaaacctctttccttcataaattacccagtctcaggtagttcttcatggtcgtgtgacaacagactaatacacccagctaggaagtggaggagctggaattcaaactcaggtcttattgactccagctgtgtccacaaccatgccctcattaactctcccctgagtgggccctgcccttcccctaagatcaggccattccccacatcccactgtctccacaaactcttttcgggctcttgttgggctgtgggtccttggagccccactcactccgactctgagacttcagcccaggtttctgctcctctgaagtctgagcagaaatcggaatattaaacttactgatgctgttgctaaaaatcaggctgaggtagtggcaccagcacgctgcttccagcccactgagcttcatcctgcttctcgggagaagaaggggtccaggccctctctaccaggtactggggcccaattctgcctgggaactgagtcggacaggcactgggttggacatccctacaggcccgggcgtctgctcacttgtgatatctgtaacagtggctcacacttctaaacaaatcctcagggccaagctcagctctccggctccacatctactggttcatttaatcctcacacccactgtattagttccctgttgccactgcaataagttattacaaacttagtggcttaaggcaaatgtattatcttctagttctgtagggtggagggctacacaggtctcactgggctcaaatcaaggtattggcaggactgagttcctttctagcggcttccatatggaagtatgtcctcctctgggacctggagggcctaggcggcaggctgggcctcaggggcttaacatacgtcagcgacttaatacaacagaagctcaaaactggggctcctgattgggggttgggggacaaccttgcaatgtgtcattcagccccaggtttttcccaccttgtgggctccctctcttctaaagactttagttctctgcattcagccgtctggtgggggaaagagatggagcacgtgtagggcagggttttatgggccaggcctggaagtggcatatgtcacttctgcccatgttccatgagctaaagcttggtcacatagaccctgctaagtgcaagaaaggctgggcaatgtggccagctgggcgcccaactccacctccccggtgcatcccggatcccctcatttctctccatcttcacacatttggactacactagccttcgaactggcctccactcctagccaccatcccttttccccatgacagccaggggctctttaaaaaatatgaatcagatcattgtggtggtgttgcgtgtgtgtttgtttgcctgtgtttgtaatacagcctttccatggctttcaataaacccacataagggcttgtaagaccctgtgtgaagttgcctctttgccttccttctgctcccccaaagtatctgccccccagttctctgggctccagcgacaccggctcctctgctattctggctgccaagtcatgctcagttctgttttaagcaccaccttagatggtggggttcaccttccccaagaaactatcccttttccttctttctcactcctgtcttaaattagtttcttgtttgttagctggccctcctcactaggatatcacttttacttacaacaggaatgttgtttgcaccagtaggtgcttggtaaatatttgtcagaggattgactgactgaatgaaagaaggaaggaaggagagaaggaagggaagaagagatgaagggacgaagggaggaagggagggacggagggaggaagggagggacggagggaggaagggagggacggagggaggaaggatgggagggaagaagggagggagggatggggaaaggagtgaaaggaaggaaggaaggaaaggagggagggagggaggaagggaggggaggggggaggggagggagggaaaaaggaaggaaggaaggacggaaggaaggacggaagactggcacgaggtcacaacatgagttagtggcgggaacaggacttctgcaggcccggggtttgggcctttgcttcagatctcactattcacagacacatgaaccccgggcaggcgagtgggaggcggacaggggagcggttcttccggcccccacccgtggcgatcccagcctccaggttcccggcagtcgccccgcctcgcccgtcacaaccctgccgcgtggggccggggttggagggggcggagcgcgcggtccgggcacacggagcaggttgggaccgcggcgggtaccggggccggggcgccatgcggaggccgagcgtgcgcgcggccgggctggtcctgtgcaccctgtgttacctgctggtgggcgctgctgtcttcgacgcgctcgagtccgaggcggaaagcggccgccagcgactgctggtccagaagcggggcgctctccggaggaagttcggcttctcggccgaggactaccgcgagctggagcgcctggcgctccaggctgagccccaccgcgccggccgccagtggaagttccccggctccttctacttcgccatcaccgtcatcactaccatcggtgagccgcccggagcctccctccgcgcccgctccagccccagccgtcccggggcgcctctgggtttcggtcccacctctgcccccgcccagctgagctactttggacgggtcatttcggctcaccgagcctccctcatctccttcgcctccctcgtctccctggtctcctttgcccccctctgctgaatggagctgtcagcccacgcaggcagggacgggaggaatcagtaaatcgagtttgccaaaaggctgacccaggagtgctcagaaaacgtccaaggggcttggagataggtgaagcggggctgggagaccaagtggctggatttgcttttccttgcctggttgcctcacacttgctgtgtgaccttagacgagttgctcaacctctctgagccagagttttctcttctgtaaaacagtgtcgctaatcggccttatctcagggctgtggtgagagttattattcaggagacagactatgcacagacaaggcctgtgctaaaacatgacacatacagagcactacaaagaaaagatcatttttttattattgcaattgttattgttaccccatgagaatggggacccagtctgtcttagggactgctgtatgacccgtgcctagcatgcagtagatgatcaataaatacttgttaaaggaatgactgataaccacaggctctggactctgccctcagggatgcagagcagttcctttggagcatctggaccaccagctgttgccatgactaccatctggctggtacctgctgagcctaaacctgggggaacaggaaggagagaagtgggctctgcagggctccaggcttggtgccagccactccccaggctccagctgtgaacgtcccggcaccccccctggggcttggatcaccagtccgaaagccagtgccttggagaaagtttccccataatgctcttgcaagtgaatatgagctgtggtttttgcagtggagttaaaagtatgagttctggaatcacagagactggagttctggtctcatctctattgccacctgccttctctggcaattgattccacctgtccaagccctggtttccccaaaggcaaaatgcaattgttcctacctcactgggtgactgccaggtttcagtgaggtcaagcatgtaacatgcttggcacagtgcctgaagccaagtaggcactattcatttgtaataattcattatttgccaacgtggctccagctcttattcagctcttttgccccctcctgtccacatggacacccctgcttcctatcttggtacacctgagaccctcctggttaccgtgcccactggtctgggatgccatcaacttgttctctctgcctttatctacattctttggaggcttgccatgtggttttggcctcttaccctggttctttacctctgaggtacgtctgggaggctgatgtaagagactcaagtggaaacaggaggaattttgccttttctggccacttgggggcaccaccaccctctgtggtctagtccgctgaagccagccttgcagagagccaggtgccaggccccaggaatttgggctttgcttggatgggagagaggcactgaagcaatggagggtgctggttaatagctcaggcctgtggagggtgctggttaatagctcaggcccgtggagggtgctggttaatagttcaggcccatggagggtgctggttaatagctcaggcctgtggagggtgctggttaatagctcaggcctgtggcctttgggcagttttgtccctctgaacctagttttcttatctataaaatgggaataacaacatgtcatatagtcattgggagggttaaatctgataatccatgcagagtacatacatgggttagttactgtcattattagttattatcattattcatttcactctctgccaaaacctggcacagtcccaaacagctggaagccttttattcctaaagagactcttctgtttctcaccagcacccccttcagcttggtttgattcaataaactctcattgagcttctggtctacgtcaggctctgtgcaggaccttggtgatggggactacaccaccatcgtccccgccctcaaagagctcaaagtctagtgatgagcagaccccctttctcccaaaagtaacagagaggcaaagtgatagggctatgcaacagaaatgtggaagtgcagccacaggcctttaaatgtatgtagtgctgatattctgaataagttatatatgcacacagtacacacttcacagggcacaaaagggtatggaatgaaaaggaattctccctcccaccctgtctctcagctcataaattcctcttcctgggtcaaatacagttgccagtttcttgtgtgtccttctggatatattctctgcctatatattcctttaaaacacacacattgtatagacgttatacacacagttttgtctcttacttttttcacttatagaatatatgttgatgtttttatgtcagtctctaaagagctgcgtcatcttgtttgtagggtttctcagcattggaactactgacatttggggctgtggggactgtcctgtgcattgcaagatgtttagcagtgtccctggcctctactctctagatgccagtagcacacagccatccccactcctcacccccatttgtgacaaccagaatgtctccagatgttgccaagtgtcccctcaaaggcaaaaccaccctcgattgagaactgctactctgtagtatcccatggtttggatggcactataatttatttaaccaggcccctttggatggacacttacattgtttctcattttcgctatgaccgacaatgctgcaatgacgacccaagtgcacacatatttttgctcatgtgtgtatattgaagggctaacttcctaactgtggaactaccttggtcaaaggatttgtattttttactttttggcaggtagggccaatctgttagaggaggcgcattcttcttggcctcctgactcttcctggcgtacaggctcctttgagaataccatgaaagcaactgctcctctttccaggaaaagacacacaatgagatacccattcattcccctgcaatggcgcggtgttccaggactcaagattgcccagtcgtgtttagattccctatagtagttgaagggacccagtaagaatcgccacgccagacaatcagaaccaaaaggtgttcagtgcgggcaggctgagcagtggagggggaggtagtcaggagaaaaggcatgtggagaggacatgctgactggggaagcagctcggggtgtagctggaaagtggggaaagttttgcttttttttcatcaaggcataatttacatacagtagaactcaccattttcctgtgtacactcctgacagatgaacacctgccgcgtaactgcagccacggtcaagacggaacattgccatcaacccccaaaattctaccatgccttctgtagttaagcctgcccccaaccccagctactggcaagcaaccacagatctgttctctgttgccacagttttgtcatttccagagtgtcatttatagggaaccatgcggtctgtaggctttcgagctcgtcttcctctactcagcttagacatttgagatccatccttggttgccgcaagttacaggagttcattcagttgctgaaaaaaattggtgtttggatgccccacaggttgtttatccattccccagtcgagggacacttgggttgtctgaagtttggggtgatgaatgacctagttaggactagtatttggagatgcccttccagccccggggacggggagggacacgccgggcaggcaggctgcgggcgggactgttgtcagctggagctgggcgctcacagccctcccctccgctctccctgcatagagtacggccacgccgcgccgggtacggactccggcaaggtcttctgcatgttctacgcgctcctgggcatcccgctgacgctggtcactttccagagcctgggcgaacggctgaacgcggtggtgcggcgcctcctgttggcggccaagtgctgcctgggcctgcggtggacgtgcgtgtccacggagaacctggtggtggccgggctgctggcgtgtgccgccaccctggccctcggggccgtcgccttctcgcacttcgagggctggaccttcttccacgcctactactactgcttcatcaccctcaccaccatcggcttcggcgacttcgtggcactgcagagcggcgaggcgctgcagaggaagctcccctacgtggccttcagcttcctctacatcctcctggggctcacggtcattggcgccttcctcaacctggtggtcctgcgcttcctcgttgccagcgccgactggcccgagcgcgctgcccgcacccccagcccgcgccccccgggggcgcccgagagccgtggcctctggctgccccgccgcccggcccgctccgtgggctccgcctctgtcttctgccacgtgcacaagctggagaggtgcgcccgcgacaacctgggcttttcgcccccctcgagcccgggggtcgtgcgtggcgggcaggctcccaggcttggggcccggtggaagtccatctgacaaccccacccaggccagggtcgaatctggaatgggagggtctggcttcagctatcagggcaccctccccagggattggaaacggatgacgggcctctaggcggtcttctgccacgagcagtttctcattactgtctgtggctaagtcccctccctcctttccaaaaatatattacagtcacaccataagcacaaaccaggctccagggtcaccctgtaggagcaaattccttgtagtccaaattgtatgagggcgtggccacatcagcacttaggagaggctctgcacaggtccacctcagagccgaccctccagagcaacttttctgttgtgaagaggctggttttctgagtaacggttgaaatgtgcaactttcaacactggaatcttcgctgcaattagtgaggtcagatgctcacactacgagaagcatggggaacaaaggtggaccaaatgggaccgtgtacagtccagtgttgacaagggggtcaatctcttgcgctaaacgatctcattctctgcccagtgtatagagtggaatcagcccatgtgtgaatgatggcctctttcccccagacagctgatgctctttgtccctggccagccccacttcaggatgagggaggccttgctgtcacccacccaccatgtcactggggccacttggacacagcagaatgccatgggacgagctctcttccgggtcctgtcaatcaccagcaatatgaccttggagaatcgcatcctctcccagggcctcagtttccacatctgtagaatgacggggttcatccagaaccctgctccctcttacgcatctctggcaggactttctggaacaggcccctgcaccataagggggcagagacaaagcccgaggtgtggcatcctggcaccccgtggcactcagccacttcccctggcttcccagatagggctgtctcaacacaaagcatgaacgagccaggttagaaaagccaaaaactttaatttcaacatgagctacatggtcatgaacacaatgcaacgcgaccccactccaacccaagggccccagaaaccctccctccctaaaggcctgggcggctgctgctccaagagagggaatgagggaaaggtgggtggatggagagaggcccccagcctaaggacccaggctcctgccttcccaccacccgtccaggaagcagtcataaagtgaaagggctccagaggtgatgctcacagccctgggttcggctccattctgacctccctgaagcgctgggttagacgggcaccatcagcccacctcacaggctcggcgtcgggtgagctcgtggacgctaatgctttctgtccactctgaggtgctgctccagatgtggggccctcccagagggcctcggagacaccataggggaacagggagaggggctcggtccctgggcctgacacagcactgctgctcaataaataaatgcaggtgaccttgcctgacgcaacagctgtgcctccagagggggtgggactcggtactgtttctgacacggaaatgcacccaggagctcctggctgaagggaattggcttgtgaagtacataaccaccccctaagccacctgctccacctctgggtgtaaaagagtgagctctgggctgttggagaaccgagttccagtcctgcccacccactaacacagtgggacctcaggcaagcactttcccctcccaggacctcagctccctgctttgaaatggggatgacggcacaggccaccacctactccccaggggctcttgtgagggccgaagggcacactcgagataaaagcattctgaaaacaaagtctgaaaagcacaacaggaaggccaggtctcactgcatctgaaggtttggggaggacttgcctgaaatgaggcgcccacagctgctcccattccctcactgccccaggcaggagctggtgtttcctaactctccctccagttggtcctgaagaggctatggccccttacaagggccctccacccaggcatcaaggtctagacccaatcctgtgtaccctcagtcagctgggccagcccccaaggagagctgagtctccctggcaaccctctcccccagacccaggcccagagaagtcactggtttatagaggtggagcccagtagggctgtgcagcccagggcttcgaggccaggaatccttgtcccagcagacatgcactggagcaacggtctcctgtcgcctgaagaacaatggagcccctagttcttccccctttgcacccttgctgaggggtcttgtgtgagtcacttcctgtttctgggcctcagtttcccaacctctcagatgggctacagcttgtcctgcccatcttttggggggccattaggcttcaaagaaagaagggaggaggaggtatgggcagtggcagccccacctcatactgccctggctccggctcagcctctattgggaggaggggacccaggctgggggtgccactgaacacacaggtgactccaggggtggcttttcccccaagctgggtcttgatttccttgtctgtaaaatggaaatggactaatggtcccaaaggcccttcaagggggttctggagaaggagagtggagatggctccttcccatggtatcctgcatgtgatcttggcccagagattgaaaacagtcatcccctggagaccccagccccccagtggcccctagtgccagcctctctgctcctcttcaaacagtgcagcctgagtcagcaaggggccaggcagtagcggggacaggatgggcttgaagcttctccgaagctaatgatgaaaatgtcactctcctccccaaacccccatcccttggtgaggacagaccgtagttcccacacccaatggtcacagcccctgggaaggggcacatgctcacgatgacacaaagaaacagggctccagcccccagctgctccacccctccaggaggtgagcgggatttcacagaacaaacaagaaaatcattgagggggccctcactgaccacccccaggtgttgttattgcttcggagctctctctctctttataaaggctgtgcagacaccaggggaagggctcaggctgtcagggccaagcccctgctccccctggttgggacagccaggctctgccctgtttttgaaaagctacccctgaacaaccacagcggtgatggctggagagagaaggcgctctcctggctcaaaatattccaatggtaagtaataaacgaacagcagagaaatcacactggttagaaaaacaaacaggcaaggggccaattctgtgccttgaatgcgaatccctccagagccctgctccttccacccccagccttgggattccacccaccgcggtcccaggaaactctgaagacctcctgggtaaagggggcgtctccatctccccttcccagtgcagggtaagcagctctgtggaggtgatatacattgaccagaactttaaagaatacccagggtttccacaggctaagggaagggaagaatttccgggtggaaggagttgcctggtgggactgggaccgggaccgggaccaggaacagggtgggaccaaaggcagcctgggtgtcctcaggagaaaacaacaccctctaatggagaccaggccccctctgccaaggtcctacaacccttaggagtccctcataaagaaagtcagtaccaagaataataaatcagaacagccgagtataacaggcagctccagctataaccctacggggacaagggaaggaagggggcggaggaggaggggctggcctcctgtgagccaggctgccccatctaggcccaggccagcgaggagacagtggtctcctggaatgtacttgaggctcctctccacccccggtcctgggactctgtaaggactatgcatgagctaagaacaggccccagggcttggagcactaactctacctagctaacctggactacgccctacacagcagggactaggtaaagagtggcaggcttctgggtgcctcccaggggaggtggcagaaatgtgcttctataaagaggggccagcctccatcctcccttgcatgcaaaagggctcccgcaggccccagggagggctgggctgggaaggcagctacccaggcctgctggaaaaggaatctcccagttcttacactcacgcctcttcacttttctctcctaccgccatctttccttcagccaaggtaattgaggccggggcagtgggttctgcccttagtataggatgttttttttaaaaagactaaaataggggggctctatttgcctccccagccccctggcctggaggcagggtgggtagacaggatgaccattgacctcatgcaacaaggaggggttctccaatttgagaaacccttatcttggcaccaccagtcccaatcccaactttccttagcctccccctccaatacagcacccccaaatgctctctagggttggggttctggaaactcaggttccacagctcctccaccggaacacagacgacaacattctttctagtccgccagcggttcctaaactagcttgttgcaatcccatggagcgaggcacctaggggtctgtgccaggcccccggcacctcctcctttcctttggtccctgctgaaccccaattcctagagccaccagaagaggggcaggcaggaggggacggacggatggactcggacaggctgcggcaaagctccttccacgggcaggcagagggaagctcaagctcctcttcaagtggggggctctgggcccctgggagctggctccggatccttgcaaagctgccccttcatctctggggcaggagtagctgcctgaacccggtgccgcaggaaagacacttgctggtaattggcaccatggagatggccggctgggttctggacatggctctgggcagcgagcttccgaggaggcaaaaagggggagaagttggacagtttgggaagggagagtggtctgctctgccacctcaatctttcctttctctggactgcagccacatccaccaggtcaagaaccggccaagtcaaaagtgtagccaatcccgttgggagaggggaggtctcgggggtaggaggcaaagaaggggtgaggaggggcccaagggggggcaggtctccccgttctgcttccccactgtgggggagagccccgtcctcctgttcaatgtgcccctgggcctggggtcccaggtcagggctgggtggtctccaggccatcttggggagcccctccccattccagcactaagatcgttctccgcagggccccacggtgctctcgagggacaactgggatgcctgccggagcagggggcctgtggctgggtccaccatggaggaggtggggaagagcttgtaccagcccacggccagggtggtcaagtccagctcctccagcagcacgcgagccacacccatgaactgcttccgctccatccgcccgtagttcccccacacgatcacctgtggggcaagagacacagtggttcaaatcctgccagtgccactcacaggcccagaagcagaacctgggtcgccccatgcccaatccagctcagtcctgtgatttctacctccttaaaactgcaattcctcaacaggcctttcttatcacggggcatcacaccaagcccctggcctccagaggctgttgatggtaatggtgacggtgacgatggtaatgggtagaacacttgctgtaggcaaaactgcaaatacttttcctgcacacagcacacattccactggcaccagaatgttatcaggtaggtactattagggtccccgctttacagatgaaggaactgagggtcagaagggaacttgttcaaagttgtgcagtaagttgtggagctcagttcagccacagtgaactgagggcctcgcctgtttcctccaggcgaggccctccagagacaccccccgccaggggtgccctcctctcattctggtactgtgcatgtgtgctcgtgcacacacacacacgtgagcgcgtcaatgcccctcacctggaggactttgccctggggactctcaggaaacagcagcacctggttatacagtgggtccagcgacttgcgagcgactttggtcttcttcttggcaatgcagatgccattctctagcaggtaggccttgatgtaggccgctggggatagaggccagcaggggtgagttctagtttggccctcaaatggtgggcaaagggtgcaacagagggaggctgcccaccctctgctggagataggtgtgcccccatggggtctggggaggacgcaccaggacacatggggggtgggcatttgggggcagcaggtacagctgggcttgggtgcagcctgccccacctcctctggtggtcctcactgtctccacccttcctttgctcactctgtgctcacctgtttcctctctcagtccataatgtgcccaccccctccctggcttatgcatctatctgctgaccccctcactcaccaagcctgagcacctactgcatgccaagaaccctgctaggcactggggtataatgataagctggaaagatggtccctgccttccaggagctcagtccagtggaggagaggaacaaggtcaacagacaatctcaactggctcttcaaacaaaccctaaactaccaattccacataagacatcagagttgggacagggggtccccacagttgggcccaattttctctcttcaaggccctcagtacccatcaggatatcctccctgacctccacccccaccttgcaggggaaggtaggccccagacctggcagtgtcttggagcctggcttggctgtcagtccccgagcctggataatgtccacctccaactgaccgttccgctcctgcagaccgatctccacatcccctggaagaggcaccaagagatgagactgggaaatggttcagaagctcaagcttggactcagctcttctcctttacttagggctgaaacccccttcccctgctcccagcccagaataagaccagaaccaactcccaccaagtgcctaggctctgctgagggcttgagagtgtgccctgggctctaggcggcatgcgcagaggatggatcaacaggcaaaggggaaggagggagagacgctgagcttctggtgtgacacccaactcccctagtccatttgaaaccagccttggggcactcacccatgggtgtggtggccagggtctggcggcccacaaactgtgccggccccatgcttcccaggaagtcactgaactgggcgtccgacgccaggcaaactcctccatagttaaggctgcaagaggaaaaggtgagacaaagcacacattcccagtggtttaccaacaactctggactcaagcagtcaacctccatgcaatggatatgctgaaacttccctcttgggatggagataaggtttacccagtatctggctcatgtggtttagtgccttgatactcaaagtgtggttcagagaccagcagcatcagcatcacctgggaactaattagatacatagaactgcagcccactccacccccagctgctgaatcagaatctgaattttaatgcgagccccagatgatgcccttgcacgtgaaagtgtgagctgcactgcaaacggctctagactctgaggggtgcatttcttgcggctgcttggctacctaatatccacttccccttcctctggtaacaagatctcaaattttctttacggaaccccctccccgtggcacatgatcacagtggggtggagggaacagctcctgagactgggcctccagctcagcctggccaatcagggcatcccttcccctcggccagtgatcagctcagagacaggcatgtagcccagttcagccaacaagaatcaggcctggaagctttgtttgaactatggggagtgagacgctctctttcccaccagacttgagcctgagatgcaggactggagcttctggtgctatgtagctaccatctggatcccgagaatgaaaccatcaaaatgacagcattgtgtgagctcctggatcaagctctgcctgaagcaagctacttcatcttttggttacgttaagtcaatatcaacagcaacaacaaagataattttattattttgcctaagacagctttagtcagttctccccactcccttcacttctctaagtatctctttcccatctgtgaaatgggaataataatgttcccatctcctaggtctgttgtattaagtgcgatgaggcactaagtaccatgcctgatgtgcctctgttatcctgagcaccaaagcacttgcaacccattttctcatctgatcctcaccacaaccacaggaggttttttttgttgttgttctggtttttgttttttttttgagacagagtttccctctgttgcccagtctggagtgcagtggcacggtcttggctcattgcagcttcgaactcctgggtttaagcgtttaagcaattctcatgcctcagcctcccaagtagctgggaatacagacgtgtaccaccacgcccggccaatttttgtgttttttagtagagacagagtttcatcacattggccaggctggtctccaacccctggcctcacgtgatccacccacctcgacctcccaaagtgctgggattacaggggtgagccaccacgcctagcccaagaggttggcttttgatctttatcaccatcttttaaataagaaacacatttgcccagcaaaagggtgaccctattccctggccagagatgaggcatacagagtcagaggcttaacccaagccaggccaatcaaaacctctctctgggaaataaaaaagagaatcctggagactaaaagtcacaagaactgagccatataaatggcctgccctcaggcaaaacccataaactctactagctacccagtcttggctgcccgattcttccctgaaccatttgaagtcccccagtgttctgtttttacttaagttatctgcagagttaatggcagaatattcagcctgagtgctttcccttttcctgatttcctactacccctggcttgctttccccattcagacagtagccagggtgtcctatgttggctgcctcagagaaggaatgacccagcaggaggtagagagcaagagacttgggctcttgacttttcagttccaaatctaagaaacagacttgaaagaataggtacaaaactaggctatcctgccccgaaacagacaaaccctcagcctgggagagcagaggaagtcaggcaaggagggaacagagctgagatgctgcaggatccttgaggacggtctgtagtctgcagctggtgagtgctgggggatgacagaaaactccagataggctggggggatctgaaagcagaggagacttgcacttactcttcttattgggtggagctaagaaaagggcagaacactttacagaaatggctacttgggcttcttgtcaagtaaccccctgggagatctctgaggctctctgtacatccctccataccctagagaggaacatatgatccaggtgcactggagagaagggcagatccatagaggcctggtggtctgggcaaagagaagtagctgagaccaatgagaaacaatgaccaaggagcagacagtaagatcacgttccaggagacaccaggatgatggatgatgattgcagaccacacactctgtccccagtgtctgagcaccacaataatagcagccaatgctactggacacgagccctcactgacattcagctggtacaccaggtgttatggccggcgtccatttgatccattcattcaaccaacaaatgtttactgagcacatactatgcactctattgtgtccaggcactattctggacacttggaatatgttagtgaacagtgatttctgcccttcaggtgcttagattctagtgacatattacacacaattaatatcataaacattacagtatgttagaaggtggtaaatgatagaaatcttagtaataaataagtagagaattaatgtgggcagggggggatgtgggcggcaatacaaaatagtgtgatcagtagctgtgacttgtgcttcttattaaatactttgatagttaccctgggcctgttctagaaatttacacagattctctccacataaacttccccaggacacaggcataacatttgggaaaatcctgaaccaagtgggtctaagtttccagcaaacagaggacacagcgggacttgatacagagattagcaacagcgaactcccagtgctcactaaatgccacaaatgtcaaagtgctctatacttattaattcatttcagcctcacaacaaccccatgaggtcaatactgttactgggcccattttatagatgagccggagagttaagaaacctacccaaatgacacaggtactgcatggccccaccctatccctcagcactcacctctatactttgaagctacctgctctcacacctgccactaggtctgagggcttattttctggctgtgagaattctgaattttgctggggaagcaaattcagcctgtggcacagggcaggctggaagcacctgagggttcatgcctcagaagcagcccccacccagtgacaaactgggagtctgcaggggggataatgcaggtgaatgttcacccagcctcccaaggctccccagtgggcctgagctccagctgcccttagtggtagcaggcttgatgacgcatccgttattagctcccctcccttcccatcccattccttgcagctcccacactcgggttgcctgggatggcctgccaaataaccagtttccacttgaatctttgaatcagggtctgctctggaagaagccaaaccaagacagaagctgagtggtatctgaacccagagagtgaggcttccaagtctattatcttaacaattatgcaacaatggtttttttatagacagaaagtatgaaaaaataaagtcacgtaagtgtctggggactgaaaggtatacccactattcttgcaaaaccaaagacccttaattaacagcacagaggctatggtctagaccaggggtccctaacctttttagcaccagggaccagttttgtggaagacaatttttccatggactggggcagggagtgggggatggttttgggatgaaactgctccacctcagatcatcaggcattagttagattctcacaaggagcttgcaacctagatccctctcatgcacagttcacagcagggttcatgctcctatgagaatctaatgtcatcactgatctgacaggaggcagagctcaggcggtaacgctcgctcgcccaccgctcacctgctctgcagcctggttcctaagaggccagggaccagtacccctgggggaggcccctggggttggggacccctgacctctttcacactggtgacatggcctttcctccatgcccctgggtctcttttccaccctaccctcccagccatctagggggccagcctccattttgtaaggagtgtctgggctccaaaagcctgagaaatggtgggggtctcacggattccaggcatggaaggagcgcagcctcccaggcagagggaggccctctgcagcctgaaattgaaagtttcctccaacgtcatcattgtctgcttctcagttcctggtgggattgtgagcagacaatggggaactggcaggcctggtaattagcggtaattgtttataatatctgggcggctgcctgatttcctatcccagggagccttgctagctgccaaggaacccggctgacgccccagaaaccctgaataggttatcacgtcctcctgggggctggaggaaggaggaataaagtggtggctgggccctactaggccagaaatccaactgcgggtcttccctggagtacacaagaaggcagaggccgcaaaatcaaatctgcctctacaactcactagccaactgcttgctgtgtgacctctgacaagttgttattgtctctgcatttcaatgttcttatctgcaaatgaaatcacactgcctcatggacagtgtctggcctttttgttggccagtgcctgtgctgtctcagtttcaaatgtttttcaaaatttctgcttacggcatccatgagcacaggggtataaaagagcttattgcattaagtgctgcatatgtgctacaactttgacaagtccttgtatgcaacaggagctcaatagatgttcactgccaaaccctacagcaggacttacactgggaaaataaaggatggagtgaagactggatttggcataacgcagaccctggatgccagtactgtacaacctgtggcaagtgtcttaacctctctgagctgcagtttcctcatgtagaaaatgggaataaatagtaattaccttgccgagttgttggggagagtcagagagctagtgtaggcaaggtgctttagcacagaggacctgctgagtgaatcaaagggtgagataccatggcctgctgggcctgctgcctggcctgggagagcctccttgccacattcttggcattttcatggcatttcagattctagacctgttagtaagtacagcatctggatgcctgagaataagcccaagccattctggggagtactgcagcagcgggtcccttccagggacgtgtgccacttggacaggcgcaaagccctgtaacaggattacaacccatgttctgctggccttttattttgtgttaatggtgaaatgagattccctgcatttcaaatcctattacttttgtttgtggagctgaaacccattggtcttttattattaacctctgagcttggtttggcccctggattttctgtgttcttgatggtgaaagaagtaactggctcacgcaggggtttgactccattctcttttccagatggatcactcgtctcaacagcatcagaaattaaaaggttgcacagcccttgtggtgattataggttatgtgattctcaaaggtttaggagtttacgggttccctgtccatccattcactacatgctcacctatccatccatccatccatttatccatccatccatccacctatcacttcatccatccatccatttatccatccatccatttatccatccatccatccatttatccatccatccatccatttatccatccatccatccatccatccacccatccatccgtccatccatttatccatccatccatccatccatttatgcatccatttatccatccatccatccatccatccatccatccatccatttatccatccatccatccatccacccatccatccatccgtccatccattcatccatccatccatcctcccacaaactcaccaagcctacaatgcaatcaattctgctgtaacatgaaatatacatttctaaaaattactgtgcaacgcaaaatcttgctataaaaatcacacagcttatgggaaaatggggtcagtgtcacatcaaaaacagaaaaaggcaagaatgcagtaaaaatgaaagcatggttttaaatatgttaaatgctttagaaatgcacaaatactacaataaaaatggcatttgaccttgaaaatgacctgcagtttgcttgtggaagtgggtgtcggaagaggtgcagcctgtgagtgattgtgaggtggtgagggaaaaactgaagtcaatggaaagttgtaccaccaggtgtggacaggtgtggcttataatagtaaactgagggtgccgtggatgtctgaggcgcatgtgttttgtgtattcttatgtgggtgcagttttcttcattcacccagtgctcctcgtggatgaaattgcacctgaacaaatgcaaaatttatgttatgctcaaattgttccctaatacttgaatcatgttggaacaaattctcgttttcaaaacaagtactgtagcagaattgccctgtgccaggatataccatatcatacaatcctgaccccgacttctcaaccattcaaggtatttccaagcctgaccacctctatgagactgtgtgtggctcatgggtgcaaagccaaggatttatttttttatttgtcaaaaactcatcttgagccaagcactgatagtactatttatcaatgttgatccatttaatcctcttaacaactctataaaagctaggtatttgtaattaatacccattttataaaatgggaaactgaggcacagaattgttaagtaattgaaccaaaatcactctgctaggagtggcagacctaggacttgaacctggagagtctggctccaggattcaccctcctaagcactgcgttatactgtctctatttgccctgaggggacctcagccttgcccagagcaaagcacagggatttgcaggtcaaagctacggggtcaggcaggcctggaactgaatcctgactccaccactcactagtcgtggaggcacattcttcacttctcagagccttggtttactccccaggaaaacaggaataaagaacaataggataatcccagtgctgttgtgagtattaaatgagataaacgccttagaacagagtctggcatactcaaatgctcaagaaatactagtgcttataaaacaaaacaaaacaaaacaaatccctgtctcctagccacagatgcatccagctctgctttgtcctttgggcacgggaatgctgctaaatagtagaggtggggaagaaaagggggttctgaccacccacccaggctcctgagcctttggtgattaggaaacagccttggtagaaccgtgaccctgagcccgggttcagtggccctgccactgccttacactctgcttccctgggctgtggacacagtgacccagacactcagagacctggatgccgatgacccagacatctcgggacaacaaagaacagagggaagaagcaggtgggtgctgggagccagcctggagcgcttctgggtcaacagagaggatgccaaggccctggattctgtgtgctgaaggggcgggaaggagtgaaatgtatgcatgcttctgctcacacacacccacctattattcatcagaatgtgcagagcaccaactgtgggccagctagacaggcattgaactcagtgtctagtgggacagacagacacacatgtgacaagatagagagtggagggcactgtggtgggggagggacaggggactgtgagagctgctgatacagccagaggaacggtaggccctacccgttccattccacttctgcccacgcccaggacagacattgctaatcaacctcagctctcctgccaagcctggacttggctccagaatccttctcaacacagcactccagggaaccactatcaattactggtgttggcacatgagatacagcctttgtgccagttctcagctgaggtctggagaaggaatgagtcagagggtgaagggggagcaggggtagagaaggaagtgccaggtagagggtgcaatggatgcaaagacctggaggtgagaaaagtgaagggtaaaggttcagggtggtggagtccccacatggatggggactgggagaggctgggaaaagtcagaagaataagtgctgggtggcaaactgtggtgttcaaccaaaaaggagacctgtaggtgtccaggcaagagcgatgtatggccttgaccaggagatggaagtggggaggaatggatggattcaagagatcattaagaataaaatggcacagcatgattatggattgggaatggattatggattggagagggggaactgtctgcaagaaccccagatttctggtttgggcagctggggagatggtagccctgtgcacccaggcagtgtagcaggctctgctgggccatccccccaccccttattatgtcagtgcttgctgacttctaaccgccagagtctgcatgcctttgcccaggcttctctggcccctgaagagcttctctagcctcaagagcctatgttaccacaggaagagccagagttaacagggagcagccactgctcagtaactcgttaagagctggaatataaatacctcagctccctcacttcctgaggagataactcccaggtgcatgtttcacatgggttccgagagttccccatcaggattggctctggttgcccaccaggaaagctggcttcttaaagcatgctttgttgggtgcatcacctctctcccacatgctcctctgctattattttctagaatcacctcccaggtgaatcacttgcacttgaacccatgtctcaggtctggttctgggaaaacccaaactagaacacacgtcaatagggagtatctcaggattagggcaggtggggagtatggtatgtctggaaggttctgttctcacggccccatctcagagggcttgagctctagctcctgcccttttcctgggtgagatgggcctggcctggtggcatggctggttgactctgcatccttaacccacagagctccaatttctgatcaggcagaaacaggctcaaggaaagaaagcccttccccagccccaggggatcaaccacaactggcccagcatgaggcccatggtgtggaaagagagaggggctctgggtccttgatggcatccttgaactaccaaaccatcctggaagcctctacttccaaaaaacttaataaatgcaaccattaaagagaaaaagagtgtaaacattaagggcagatacccaatgcccggatttgaatcccagctcagccactgactggctgtgtgacgtggggcaacttatttaccctctctgagcttccatttcctcatctgtaaaatgggaatattaacagtcccattgtcaggttgttgtgacaattaaatgagtcaatataagtaaaagcccagcacagtgtctgcacatagtaagtgttctctgcaagagttagccacggccattattaccattaagccagggcttctctaccttaatgtgcatacaaaccagctgggggtctcattaaaatacagattctgattcagtgggtctggggtagaggctgagattctgcatatttaacaagctcccatgccagtgtttctgggctgtggatcacacttcgaatagcaagggctgaagccattgtccattggtattacataacccgggactcaaggcatcctcactgacagagcgacccaacccacaggcaccccttccccatccctgacaccttgctgggaacacaacatttcccaagttttctatacctgtcctttgcagctctccccacactgctagttgcttagtcagtgcccaagagtggaagctcatggaggacaaggtatctgaggtgcctgacccaactgcctggcacattctaagtgctcaatcacatctgctgaaatgaaaatcctgtgcctacctgcaggaatacatacgcctggtgatccagcgcagtcagacagacccagcggtgccaggggctgcagccttgcgggggtgctcaagtggggctggctccctgtaagcctcagctgggctggcagaagcccaaggggtggggagaagggagaacagtcccttcctgtttcagagcccggcatttgggccaaaccagtgcccaaaatgcctacagaacaagaagtctgaccacagctcaatgtccccacccattccttctgtgtccctacctcgcccaggtgttgggcaggtggcagcgcctcgcctggctgggatccaccaacactcagctcttttcaggaggccaagactgtcccctgctgctggacccgtcaccctccaacccacctgatacctcctcagttgggctcagaacacccacctcaagccttttagtaatcgtaatcctcacagccaacacttactcagtgcttactctgtgctaagcactttatagacacaactgtatttggggtggctcactatatccgttagaatgcaactgaccaaaacagcaaaatagccaacaaacagtggcttaatgaacaacaaacaataatagctaacaattacagagctggtcactgtgctaagttcttttacatgtattaacatattgaaccctcacaactctgtaagtgtctgcactgttatgtcccctttctatagatgaagaaactgggctcagagaggtgaagtaacttccccaaagccacacagctactaagaagctgaaatgaaccacataccagggcagtctcgtttttgagtcctggctttgaacctgtctgtaattagactctctggtcccttaaaacccattacagcaaacagtaacaagagccatgttccaaacacctatcacctgcaggcatcacctcgtttcttcctcataacacactctgataatgctccccttggtcatgtggcctttctgagccttcatctcctcttctataaaacggaaatgcaggtttgacttctctgctgctgctcactgaagcacgttgcccttcccacaatctagtcctccagacctgcccgtgaggctgacagatatttactggcctcaaacatgagagaggtccactgatgtgctcaagcccacccaggggcatgagtggcagagccaggattaggacctgagcttcctgactccctgagactcacacctgtcagcagggccccactgctccccagatgctgagaatatcttcctccaagttctgctgccttgccatgtttctcaggttaaagaaaacactggctcccttcctcctcctcctcctcctctcccttccgctgtcctcctcctgttctcgcccacgggaaagtctcgctaggaggtgggtggaacagcagcatctgctaaggcaaggccattcacgaggctgaagatgcccagtttaggaggggctgggggtggggaaggcttttagccagcagaagcccccagctgaggggcagggccagaatgaagggaagcaaaagtggaggccaagccccagccccacctctcagtggctgtgtgtctgtccttgcacaagtcacttagccagtactgttcaaacgaattttctatgatgatggaaatgttctattttctgcaccacccaatatggttgtcgctagccacaagttgctagcgagcacttgaaatatggctagtgcaatagaagaacagaaagtttcatcttatttaattagccacatgcttctagtggctacttttctggacagttgtggaatttaacttttctaagcctcagtcttcccatgtgcacaagaatcatgatatcccaccccacttccctgactttagacgatagctaggaccatgaagcgatgcagtgctgggaaataacccctggctgggagtcaagactcctgggttccagacctggtaacacacttcatgatgcagagtgagctctttaacctctctgagtgccctggtcatctgtatgataaggaagttgctttggatcaaagtttctttgatctagggatccatggatggttttaggggactctgataacccctacagttatgagaaaagcatgttcgcaggactgtgtgtgggagaatgagggtgtacatgcactgagggctgtgtgtattgggggaaactgggcccaatgctttcctgaaattcttaaaggggtctgtgaaaatgagaaacccctagtctaggtgagttgctctagggtaaaagctttttaacagtggagttctcaggccacactcccagagactaagtcagcagcctggatgtggggtcctgcaagctgcactggtaacgtgttcccgtgattctgacgcggagcccacagagggaaacgctggcaaggagccagccacactactgtctagtgagctgatgctcaagaaatgcctttataaagcagtagtatacatttttcaaaaccaacgggatttaggaaactaaaaaagtaaagaggaaataatgatgataataaaacccctttctacccctcctttatttcttaagcagcactaatatacagcacttagtgccaaacactgctttatgctgtgtataaatatcacccctgcattatatggattgtaaacgtctaatcctcataacacccctatgaagctgatgctgttaatcccattttacagatgaggaaactgtggcttagagaccttgcccaaggtcacacagcaggaagggggtggagccaggattcaaatccaagcagcggggctcgctctccctcggggctttgctgttacactgcctcccttctgaagatgggggatgaacctggagccctgagctggcgctttcacagcctggagctgccctagggctcccagaggggttgctcagtccctcccgtgccccaccacaaaagactgcaagaaccaggagggctggtggccccacacttacttgccctctgagccatagctgttcatgctgtcctcaatggactcgtggctggcctggcgcagtgtccggctgggcatctccactgccaggcccgtctccgtgctcctctggatggcccccttcagcctccggctgtccccttctgggcaaagcggccaagagagatgggaagagagacacaggtgggagggggacagagagaagagtcatctggttagcagtgtttcagcagctgggggctgtccagcttcagcctccaccctcagcccatcaacctcctcagactcctggcctcaccagtaaccactccaccaacaaacagtattgcatgagttctgttaaacgatagattcatttacatgtgctttttctcccccttgaattcatttctcccctgaaatcttctccaaatcatttctcttcctcctcttcagctactatttattgagcacctactatgtgtcctactgtgtcaagtgctttgcatggattttgaccagggtttcttgacctcagcagactggctgtgtggatggcatattgctttgcagtaggggctgccctgggcatcacagaatgtctaacagtatccctggcctttgcccactagatactaatagcaaccctcaccccaccccgctgcagtccagttgcagcaataaaaaatatctccagacattgccaaatagcccctaggcagcaaaaatcacccttgattgaggactactcgcactgaaaccagatggcatgggttcaaatcctggatatctatctcagtggctgggagacttaaggcaaattactcagcctctgtgtgcctctatttgcacaactgtcaagtgggagaataacaggctcttatgaggctaaatggcccccatcagccgcccactccttccattctgtggtcaaacatcatcttatccaagatctttcttgacctctcctggcccctccaaaacagcagccttctcccaccccctgcccctctctgccctgactcctgctttggttttcctcctaacacttaccacccaaatgcgttaaacaatattggtgttttggccagcttcctctgcgaagaccataaactccatgaggacagggaattttgttcactcttgaagcctcagcaccaagaacagggtctagaccattgtagagctcaactaataactgtggctgccttgagagcagccttaatcctcacaaccaaccgtaaggtggatgctgctgttcacccccatccagtacccaaaacaggaggcacggagaggtcaggacttgtccacgcccatagagctagtaaggtggggagccaggacacagccccgggagggtgtctgctccctgctccatggcctagtgattcaagggactgtaggcttgctagaggtggggtagatcattagtgggatctttttcatggtcccacaaagtccagacatgggctgattcccaagaggatccttcaatgcttgctgattgacccactggggaaaagcagccccaatcacacccagtcatcctcctcctgccagaggacaagagagctgggcctgcgtacaggagcagggcaagccaggacagctcccgccggccttctcctggcctccctcctcctcccagctccaggatggtctctccttcctccctgcctctaagaatcacacacacgtgtacacacacacatgcatgcgtagatacaaacactctgtttctcagaacgtgtagcctcgtatttctgtctcccacgtgtctttgttattcagacacacagacacccacactcagaaaaacacagcaacacacacacacagtaagatgcatgcaaagacagtgtgttaatgcaggtctgagtgtgctcccaggggtctccacatgcctgtcgctctgtgtgtttgaggctaagtgggtaggtgtatacacatcttccctgcgtgtttctgaacacgtgggagagcgtgtgtgcccctatatctgtgtttctactccattccatcatctgttctttccctagcttgcatctgcagcctcccccgaccctctatctccactgtttctgttatttctctgtgtacagcaggtacagtgacacagagaaagaaagaaccactcacatgcacattcagaaacagactcagacagagatgtccctgtacacacacacacacagcactgtacatatgtccctgtcagacgtgcaggaacaaacaccccccccacaccccacactagggatacagacccatgactgggcaccctgcaggcaggcagcacacacctgcctcggctccctccctctctgctgagcgctgttcaggtgcccccaccccggatccatctccacctacctgggtctgacacatttctcccggaagagggaggagcagagcatgacaaacaactcagtcccccagagctgtgccttgcatctgtgtggcatcctacagccctcaaagcagttcccaaccaggccctaggatctgcctcccagcagccctggctccccacacaggtgagcatgcctttgcagtcagaaggcccaggtatggagacccggggcaagctggacggcatcttcccacggagctgttgagaggcttaaatgacagacgtttcccatagtgcgggcacaaagtaggtgccaaacataaaaagccaaaccactgcagagggagaaagaccttccaatgcccccacacctgcccttgccaactgtcttgctgacacccttgtagactcatttttttcccttgacacaccaccttccccaagctagggaccacgactggacccaaccacagcaatgtccaccatccaacctctaccacctacccctcctgtgcatcctctcttgctaactgggccatggcccccaaagtgactgttccagtgctttcccaactacccccaccaagatccatccatcccacgtggctgagatgtgttccctttgttctgctcttcctcacttccaaatgtcactgtgattgttaatagcgagtgtcaactcgattggattgaaggatgcaaagtatcattcctgggtgtctctgtgagggtgttgccaaaggagattaacatttgagtcagtggactgggaaaggcagacccaccctcaatctgggtggcatcatctaatcggctgccagcatggccagaataaaagcaagcagaatgtggaaagactagactggcttagcctcccagcgtgcatcttcctcccatgctggatgcttcctgctctcaaacactgggctccaagttcttcagctttgggactcagactggcttccttgctcctcagcttgcagactgcctattgtgggaccttgccttgtaatcgtgtgaatcaacactccttaataaactctcctttatatatacatctatcctattagttctgtccttccagagaaccctgactaatagtcaccatcctgacctttcaccctgcctggccctcccctcctttctgaaaggaaggggccgtccttctcctggctgtggctgatccatctccatcactcaccatgacctcctcccccatttgtcctctctgggccttgcgtctgctgcctctccatcctcgggccctttctagttctcccacctctttcaccaactaacttcctcggagaacagcctctggccaccaagtcacccaccacaccctctctgatctctcagtgtggctccagcccatcgatccatcagggcggcttactaaaccattctctagtgactgctcaccaccaggtctcaacccagctcccgggccctgaagcatggccctttcattctctcaacagacatctattgaacacccttttgtgaggtggaagcccctgagatgttaaacacgcttctaagtgctgcacctgctgataaaacacactgacgggagccagggagaaatgaacagcctctgcttgtcgtccatcaggacccagaaatagaccctcacttgacccactgtagtgaacaatgtgatcctcctccaagaccccctttttaccacttctgtgagcccctccccactgtagcatgctatgtgctgtggcttcccacagccagtacctggcacctttttctggggtggggtgtgggggtgtctttctttgggctactgagcccatgttgcccccacacaggcagagctagaagtgtctggaaatgtatgacccttaacctgcccttgccctgccccttcatcaaagactaaatgaaatgggaggatgaaccctcacctcctctgccctgggtcagaacaactctgaggcttcacgcagcccccagagtaaccccacagcggggctggggccaccctttcgggacctgcctgagagcacaccattgcgtgtctcctgccctgtcttgttctgcttccctgggtctgttctgggggcacttccttcattactgcctccacacgaatctcatctcagggtctggtttggggacacctgacctaagacaggctggcaccctaagcaagtaaaagttcaaaaatcttcacacaggtgggctcccgcatcataactgtagttgtacccatttacacccaaccagcacattgggaaggaaatttatttctcttttgtatgcttctatgtcatttgaattttaattaattctataatgcaaatgaaagtaaatacaaacaaattcataaataaatcacagcttcagtcatgccaccatcttatttaaaaccttagccaggcgtggtggctcatgcccgtaatcccagcactttgaaagacccaggcaggtggatcacttgagcccaggagtttcagaccagcctgggcaacatagcgaaaccccacctctacaaagaaaaaatacaaaaattagccgggcatggtggtgggcacctgtagtctcagctactagagaggctgaggtaggaggatcgcttgagcttgggaggttgaggctggttgcactccagcctgggtaacagagtaaaatcctatctcaaaacaaaaacaaaaacaaaaacaaaaacctcagaatgtttcttcactgcctgctgaattaggttcagtttttgcacccaggcatccaagactctccattttctgactccctccccatcagctactgctctccctcgcagtctctatatcctagcccagccagacacctcagtgctccatcctgagaaatactgtacatcctcaataacttcctcatcctggttctcactcctctcctttcctccttatcaaatttctaaccatcctccagagtttagctttaaataacacctataacttatcaggcactctgtacttcagtttcttcatcatataatagggataaaagcaccagaatctcagggctatgtgagcactaaatgttaacaagcaagcaacgtaaaaatgtaataacatataaccctcaggatggcctaggtgggctgggacacacggtcagccctcaacaaagttgactattattaatatggttattaccattgtgctagatgccatgccaagcgttttacaaaggtatctcccacttaattctcacaataaaccatgagatagctactgcccccctttacagagaaagaaaatgaggatcgagaaggttaagtaactttcccaaggacatgcacgactactaatggtggagctggacttcaaacccaggctattctggctccaaagccatgttttaaatgcaccctaaagtaaactctccaagctccatcccagaactcaaatgccatgtcttccacaaagacgtccctcatcagactccttgagtcccggggcacttcaatcttcacttctcttggggtaactattccatggcaccttgaaacacagttctcatccacctagtcgatgtcagtgtttacagcgtgagctcattcgtcatttacttccattcagcaccagggatagcgcccacactgcccatccccactgaaagtgtgttaaattgaattggctttaggatgtgtccccaagaaaaatggaaattctctctggtaaagaaaacaagtagatgtcactctgctgtttatacttgaatatgaatgtgtttaatgtacgttctcccaaaagcaagtattcataaggaacaggataataaaacgatgataaattatgaaaacagattctattgtttttagcatttaccctgtaccatgtacaaattatatacacatatataatttaaccccaccataacactgaaagacaagtattattatcctaattttacaataaggaaacaggctcagagcagttcagcaacttgtccaaggttataccagataagacagagctaggcttgaaaccaggtctgtgtgaaaacagatcatcatatactcttaaccacgagacctcagggatgtgttggggggagggagaaggagagaactcaaccagtccccactttgacattttattgaagatgggcattatcagctttgacttccagatgaaaagcctcaagccaagagaggctccatgacctgttccaggtccccaggctctaaaaccactaaccacatcctggtcagtgtgagtgtccactccaagtccatagagaagcctgtgaagttcccccagacacaagagctctgggtgactgggttattttaaaccaggatgcgaaaggcaccaaggcccctggctcactgcttccccttcccacagccactactcttcctgtatctctgagataaataccctggagactgctgcctcttcttcctccatggtcagcctctccctggcctagttattcccagtgacttgggcctcacatgcctcccttgtccaggtcttgaagtccatctgaaaatcaagggctgagagccatctgcagatactcaggcctccagagcactgatgttgcctctggctgtgtctccaaggatgggtggaggaagcacaaccctgattacttctgtgagggccctaacctttcccttctccctggagctataggaatctgccctaccttaaaataagagatggtttcatctggagggaacttagggatcatccagatcaatgcctttattgtacagagggcaactgaagcccaaagaggggcaggagttaaaggccatgttggtattagaattcaggctgggtacagtggctcatggctgtaatcccaacactttgggaggccaagatgggaggactgcttgagcccaggagttcaagaccagcctgggcaacatagtgagaccctgcctctataaaaaatttgaaaattactagcccacactgtagtcccagctactcaggaggctgtggtgggaggattgctggagcccaggagtttgaggctgcagtgagctatgatcacattgctgcactacagcctgggtgacagagaacctgtttcaggaaaaataaattctggtctcctaattgctaacctccctgctccttttcagtcaacagcctttcactatttctagagcatcttcaggaggcagcatggcctaatggttaaaagcatggacaatggagcctgaatgcctgggttgtaaacctggccccagtcactctattagttgtgtgattttgagaaagttactcaacctctctgtggctcagtttcctcctctatgctaactggtgtccacaccaccagagtgtcctcttctgccagtttcttctctactcagtggcctgcctgagcttcccaaatctcaatcctgaacacaccatccctttgattaaaacccttcaatggcaccccattgcttgcagaataaattccaatctaacacacactgtctttctgacctggtcccaatttacatttccatttccctagtgttctctacattctattcacaatgaattattccaaatcttccatgtgaccagctgcccctcaaatttcttacccatcatcctgcatacaaaagtcttagcattctcttatcttctggagaaaggtgctttttaagacaactgtttgttgcaggataatatacataaagaaaactgtacaattatatatcgcacagttgtaagtgtataccttgatgactattacaaagttctacggaaccagcacccagatcaagaagcagaacattaccagtgccctacagaaggcccacatgccacttccagttactttccaccaaaagtagcattaccctaacttctaacagcacagactggttttgcttattttgtagttttcactacataaaatcacctagtgtatattctttagcatctggcttcttttacccaacacgacgtttgtggggttcatccatgttgattgtttcattgcagttcattcattctcatgacttattgtagtacattgtgtgaatatatcaaaataattttcatctattctattgctgatgagcatctgggtgggtagcctccagtaatgagatattacaaatagctctgccaaaaacattcttgtatgtgtcttttggtgaccatttctgtgcagttcttcagggcacatacctaggagtgcagctgctgggttacagggtatgcatttgaaatgccttttaggtggattaaccacggtgtgaactggaaaggttaacacgttagactatcattcagcaggaagcaatgttctgaagaagtgaggctaaagattggaagattttgaggaaaaagatggtggaaagcctgttgatttactgtatatctggctcacatttatattccccaaatgtaatctttgttaagagaatgtgtatacagggcaaacagcacccagaacaggacaggaaggaggggaaaaggcctgtaatacagttgacattcaataaatactggctattactattaacctctctaaaggtcaatggtcaactgctcactgataccacctctagtaaactcattatttcatcgattctaagacaagcattttttcaacatctccaaaattaagatgtgaatggcaaccagtggcatgtcagagttaaattctgacatgttttagctcccttggtggtatataaagttgtgacttgcaactgaaggcctctaaaatgcgattaagtccacagcaaagaactggcgtgtgcaggaactgtccgtggtgctgactgagcacagaggactgggcctgcctagggcagaggtggggctcacaagggagattttagaactacgaagcatccctatctgtggttgttttcaaaccacaattccttcccactggcttgctggtgcctgaaattccaccctcaaagaatcatcttcccacataaagacaggaatttccatttatcgagttgaaccagagcctatgagaggtgctcagcactcatcatttcatgtaatcttcacaaccaccagtgaaggtaagtattgtcttcattttcagaagggaaagctgaagctcaggggttaatgaacctgcccataattacaaagctggcatgtgggatgtgatcctggttcaacgcaggccagagtgcaatttttgccctttacgctgctctacactggagggagggataagtgcctcagacctttttccaagaggatttgaagaggaaagaggagagatcataaagacacagagatgaagtgagtgaaagcaagaggggcaaaaggcacatgataaggatttgagaaccctagagagggaggggaaagattttgtgagaatcaactgggtaataaatatggaatgtgctttgtaactctaaagggttatgcccctggaaggaaacgttactctcacttatccaacaaaatatacatttattgagttcatttcctatgccatgctgttcttgtctctggggatttgaataagatacagtctttgaccttaagaaacttacaggtagtagagtgtgggggggacatgaaacagataagtaattattattcattcaacacactctttactaattgcctattcagggccagatcctgtgcggtagactcataacatagatgaattaaacccagaccttgctgaaactcccagtctaccagaatagataggcaagtaaaggggcaattgtgcaataattacaacgtagcataatgtaagggcagagatatacacagagtattatgggagctgaggagaagggtaattaatgcagcactggagttagaggcacggtctgggttgtaagcagaattgattcaatgctgaattatacttgattgcaaataaaatcagaagatttcattgtacatgcaagcactaccttccagtacaactgaaggttatactgacaaataaaaacatggagatagagtgaagaggaaaatgtggaaccaaatgaaaactgaaggcaaaaagttccagatgcagagtaaatgcatttggggttggggaggtcctatgctgagcaggggtggtcaggggaaagtcatttactctcctcgagccaatgtggaaagactttctaaagaagaggcatttccacaatcattggaaggaagacaattcacagtcccacaaaaagctgtttttcctcaggaagctatttccatcagcatttgggacaagctaaacaagccttggaaggaactgggttgtgggcaaaaggtagagtctatggccccatatggcactgggaagctacacaatccacacagcattcaagacttccaggatttgccccaaacctatactacaagtctgccatgatgcacataccaggtgttctatccacacggaattactcatcattcaccaaatacagcccacgtacttccgtcttcttaggagaacaggctctggagccagaaaaactgagtttgggacttgaagcatgcctctgccactttctgagtaaactaaataaacttactgaactaatctgagtctaagttcccctgcaaaacaggaaaaatgatagaatccactccacctattgttgtaaggattaaatgtactagtaagctcttattaggttatgctgcaataacaagttacccccaaatttcagtggcttacagaacaaagttcttgttcatacttaacataccttatttttctgagatggacttttgctctgtggcctatactggagtgcagtggcacaaccttggctcactgcaacccgtctcccaggttcaagtgattctcctgccttagcctcccaagtagctggggttacatgcatgcaccaccatgcctggctaattttttttttcctttttgtatttttagtagagatggggtttcaccatgttggccagtttggtctcaaactcctaacctcaaatgatctgcctgcctcagcctcccaaaagtgctgggattacaggcatgaaccaccatgcccagccatacttaacatactttacgagttagctatggttctatcccacgaactcatctgggacccagggtgaaggggcaggccctatctgggacaagctggtctcatggcagaggaatgatggaaccatgagggaattcttccagctgctgcacttttctctatgtgtatttcaaaacttttaaaagaaaaggaagggaaagaaatatggcctctaacagacagatgctgccaaacatgtaggggaggcaaggaagctccctcctctccacaaacactggaaagagaactcctcaagacaccaaatggtttgttccaacaaggtagcatattagcccatgatagcacagatccatgttaactgtgaaatagatctctcataccccttgtgggactgaactcaatgacataacatgtgcacaacgactgtcacagtaagatacaggcactcagtaaattgcagctactattataaacaatactctgagatagagagtagtgtccctgattctcagaaactctcagaaaactgaggctctgagaactgaagcagtttgcccaaggtcccacagcaagtaaaggttggagaggaagaatgcaaaacaaatccgctccattcaaacaaagctgcacacaaatgttcacagtagcattaactgtaacagtcaaaaagtggacacagcctgaatggccatccatggacgaatgaacaaactgtggtatatccatgcaattaagtattattcagccataaaaagcatgcagtactgggccgggcatggtggctcacgcctataatcccagcactttgggaggccaaggtgggtggatcacctgaggtcgggagtttgagatcaccctgaccaatatggtgaaacactgtctctactaaaaatacaaaaattagctgggctgtggtggtgtgtgtctgtaatcctagctactcaggaggctgaggcaggagaatcacttgaacccaggaggctgaggttgcagtgagctgagatggcaccactgcactccagcctggttgacagggagaccctgtctcaaaaaaaacaaaaacaaaaacaaaaaaaaaacaacaaagcattacctatacatgcttcaacatatatgaaccttgacattatgcaagtgaaagaagctggtcataaaagatcatctcttctatgactctacgtatttgaaatgtccaagataggtaaatccatagaactagaaagcagactagtggttgccaaggaccagagggaggggcaaatgggatgtgaatgctcacgggtatagggttgacgataatattctacaattgactgtggtgatggttgcacaactctgtgaataaattaaatattaaaacccactgaattgttcactttaaactagtaaactgtatggtatatgaattatatctcaataaagcttatataaatctccttccacttcatctcatctcccaggccaggctgttaaccctattctacactgaccccaagagggtcaaggagcccacaggcagggaggctccccctaagccagaagcagtgtggaaaacctgctgcaaaggccagacaaggccaacttgtacagtctgtcccctcggatgtcatcttcagataacacatgtgcacatgtatccccacaaaggcccacggatgaaaacgtgcagtgggtacatgggaagcagagatgtaggggatggggtggggttggaaatgagggaattccttccttccagtcccaccagggcaagcctcaggctccccatcaccaccttcctcaatcaacagatggccagcttcctccagagcctccaagactagagctagcaaggcttagttaagaccacctgaaaccacctggcaccagcactcaccagagcaaacccaccttggactagctgttctcagcactgaggctgtagtgatgttggccttaggcagcacatcccctgttgctccagcttggctcatccacgtcccaaaactgcttaaaatccgtctctctccagactgttctgcaggatagcagctaacccagtgtccactaaggcttctcaagaacctcccacatacatgcttaacgcacgctgggtctcctactccttggatgagcagcgctatcctttatcttgaagcagtttaaacaaatctcttccttgatttggccttagcagagttgcagagaagctgggccccaccttggctaaggcacctcccttggttgcttttctctctctcaaatgagggcagggacactggctggcactcagcaggtcctccacacagacaccaaaggctgaaggaattccagctcatggcttctcaactttaatgtgcaaatggatcacacaggaatcttgttaaaatgcagattctaattcagcaggtctcaggtggggcctgagattcagcacttctcacaactcctaggtgaggtcaatgctgctggtctgtggcccacacattgagtagcaagattctagcccattccattcactcttttctgatttctctgccttcttcattgttcaaggagcctcttgggagtggataaaagctactctctcttagaaaaggacctgccagcacatacacacagtatgttgcataaagtttgggagcctgcaatccctggattaaaagccattcttcttctttttttttttttttcttttataagagataggctgtcacccaggctggagtgcagtggcacaatcacagctcactgcagccttgacttcccaggctcaagtgatcctcccatctcagccggtactacacaccaccaagcctggataattactttattttttgtagagacagggtctcgccatgttgcccaagctggtctccaactcctgggctcaagggatcctcctgccttggccttccaaagagcttggattacaagcatgaactacctaccatgcctagcctaaaagccattctttcgcatacacaaacctgcaaatcttagttcctgcagaaaagaggatgcaacaggggatagaaaaagaaaaagccttggcagggagtgagaactcctgggtcttgtcccagctccactactgacttccggtgtgacatcagacaactttctgctcctctcttgagcttcagttttcccaccatgagagaagtggactagattggggatgatacataggttttcttttttttttttttttttgccaactctggtagctgttgcctgaaataccctgtgctaagaattcttagactgtgcctggacttggcagaaaaggatgccatgattgattggtgatgcctgccatggtcccaggaaagggggccttgattgattggtgttgtctgccaagatcccaggcctggagggtgatgggcttcctgccagatgtccgcctaccccagagagcccttccagctgtgacattccacacagctcattcagagtcatgccacactgggcaaagagaagtctgtgcctgtcctcaagggggcaggaagggataattctttaagcttctggcttctcaaacctgctgccctacagccccctttgagaagaggtagcagaatccctgctcagtggcagaggacagcatgtccttgtgctcccatccttccctatttttaactccaaggacagcagctcaggcagaagctgaaatatggaagggccacccagcctctgagggaggggaaccacacccccaccatcattcccaaactgctccatggttggccaagtgagagtcgaggcaagggacagaaggttcctcacctcccgtgtgaatctctcacagccccatcccatccttccccaggcagggccagtcacccctccttggtacacccacagacctctctgctagtccctatcctgctgcaccctgtatttgttcattcatgcaccccatttacatatatgtgccagccttcatactagtgccgaggacgcagcattgaacaagacagatgggggtcctcacccactgagctcttctagtctagggtggaagacagacagcaaacaggatggcagcataattctgtagttacaactatagtctaagtgcttagaagagaactgtaccatggtcaccccatgtgcctgtacactcctcaagaactggaattctctcactcatctttctatccctggaacctaaggcctaagctggcagaaaggagggttcagagattatttgttgattgaaaatattacacaagagacatcatgtgaagtttgagagccctacaggagcctgtctcagactagatgagattcattcattcattcactcattcactcacaaagtattttttttgagcactttctacatgtccaacacggttctaggcactggacctagagcaggaaacaagacaaggaaaaacgaactgtcctcctgaatctccatgctaggagaggcaagcaaacatcaagccagacaaatacagaaagatagagaggatgctagaaggcaataagggcagggataggagtttctctctgaaacagagtgatcagagaaagcattcccaacacagggaacagaaacgtaaaggcccgtggcagacatgtctggtatgttcgaaggagacgagagtggctggagcagacagagcaagggggagtggtgtgagatgaggtttgagatgatggggcaggaggagagggcagactgaaaaactgacacacctcacaccaagctggcatacaattgatggaagagatggtggcgatgatgataatgacaatgacgatgtgatgataaaagcagctagcattcattgggcacgggtgacaggtgctatgctactcaattaacatggatttgtttatctaatccccacaacaatctgtgaaatatgtcttatattatacccattttatagatagggaagctgaggttcaacaaaatttacgcagcctggaggtggcagggctgggacgggaacaccggccgcctggagccaaagtccactggcttgctgatcacaccctgtcctgttccacatgcaccatgaacaccagtttcctcccctcccagagttcctaaatcttttggactcctttgaaaatctgctgggagctgcttttccccagagaaaagttttggttttctccaggaaaaaaaaaaaaaaatagagatgcacaatgatacaacttgaacgtaatttcaagaggttcaaggttataaactccagccctaaaagtaagcattttataagcatttataacaaaaacaagaattttcagagttttccaaagatgcaataggggaacacaagtgtctgcaataccagctaaaaccacttccatacaatttgtcaagagcctatcaggaataaggcacttgtagaatcgtatctcatttaaacctcattttagtcctgtgaggtgattataattaggatccctttacaaactaggaaactgagacacacaaagtttaagtaacttgcccaggctcacagaggtggtatctggcagaattgaaattaaccacagatctagctggctccagacctcagtctctattccagacattctcttctggcttctccaatggcatttcttcatcttcccagacaggggaagaaacttgctcaaggtctcacagctcagcacatctggagtagccattagccacatgtgaacacttaaactttaaaaaaaaattaagaattcagtcctcagttgcagggatcacatttcaagtgctgagtagccacctgtgactagtggctacagtatcgcacagtgcaggcacagaacattttcatcattgcagaaatgtctattgggcagcgctgggctagaacttggtctcttgactgccaattttagtttttccactgtcaggggctactagaaattagatttgcttgataaatgaagttgaccatgaagaggagacaggaggtgggtgcagtggtccatacttataatcccagcagtttagaaggccaaagcaggagggtcatttcagcccaggagttcgagaccagcctgggcaacatagcgagaccctgtctctcaaaaaattttgaaaactagccagtcaaggcggcttgtgcctgctgtacaagctacttgggaggctgaggtttgagcccaggaattcaaggctgcagtgagctatgatcacaccactgcactaaaatctgggtgacagagaaagaccctgtctctaaaaataattttttaagtgggtgattttactacccacttaaaaaaaatgatactgatgatgctgataacagtgactgccatttagtaataactttttcacaatgtactccatcaactggagcagggctgggcatgtattaagcactcaataaaaatgtcttggatgttgaatttaccatgaaaatgtcttacagaacagtaataataataaattactatgaagtgaatgccttacggctgcactgcacccaaccacacttagtgtcataagccttccaataacctgaggggtaagcactgttattgtctctatttacaaatgaggacaccgagacacagcaaggttatgtcatgtgtttaaagacacagctaacagggtagaagaaaaaaagggagagggtggtttaaatccgggtctgtctgaatttaaaatctctatattttttacctcccaaatcaagagagcattttgtgtacaacaaaggtctgtacaaatgtcacttaccagtatcatcacagtatgagaatttctttttattattataatttttttgagacggagtctctctctgtcacccaggctggagtgcagtggagcgatctcggctcactgcaagctccgcctcccagttcacaccattctcctgcctccgcctcctgagtagctgggacggcaggcacccgccaccacacccggctaattttttgtatttttagtagagacagggtttcaccatgttagccaggatggtctcaatctcctggcctcgtgatccgcccgtcatcacaatatgagaatttcttatttttttgagagatagggccttgctgttgtccaggttggagtgctatgacacaatcgcagctcactttaaccttaaacttctgggctcagcaatcgtcgtacgtcagcctcctgagcagctaggactataagcacacgccaccacatctggctgagttttatttattatagagatggtggtcttgctatgttgcccagcctgggctggaactcctggcctcaagcaatcctcctgccacctcagctttccaaagtgccgggattacagtcatgagatgagccactgtgcccagcccaacatgtgaagattaatgggcccagggagaagaaggattttccacagttgagctgcctgtcaacagaatggggagattgtgagctctctttcctgttgctagaggcacccaagggagaataaactcctacccagcagggagactgggatgggaactgagctgtggtccccaggtgggacactggatcagcacagagaatcccaaatgtggttgaacatcagaatcgcctgggagcttgtgaagcaacagagtccaggctgcacgcctgatttttaattgagtggtctgggttggggatcaggatcctggctgctgacgaaaggcacatgcagcgcaggttgagagtcatggactagcaaaatgctgagtgtccttcttacccaagatcactggattacaggccacggagccactaaaggaactcaggacacactgttaaaaaacatatgatttgcccaataataatgaaggcatgctctggccaggcactgtgccaagcatgacacctgtggtcccatagacccctcctcccaggctacctcctccccaggctcctctaccctccttccatttttcaactccagcatcctctcttccaggaagcctcccctgattcccagagctggggacctctccttggggtcccacaacagatatgattctcacttgtgaatgtccgcgtctatgtttacccgctgccactccaggctgtgacaatgctagtgtctcactcaagtccttgtgcccagcacctagggcctggcccagtgcaggtgctcactaaacatctgcagagaggacttgctctgctccatgaaggatggacagaggaggcagtgaagaaagcagccgctgcaggaaggaagtaatccaggtcaccaggttggaaggagacagaacctacaaattctccccgccactgttcagaagaggcctgggctatttatagctcacaagccttctgcttcttgcatttaaatgcagggccaggcatagaataaaatcctggggaggtctgtcagttttcaaatttatttatttattttctataagaacgggagcagaaagcagggacaaaaatgaaccatgcctattagggtgcgctgcctcgtgctgtccctaggtctgccttgccaagtctgttgacagaagagttgcacgcagttctagacctgatcctagaaatcagagtatccctgtggagactggcctgtgaaggtccttttaaggtgatttttaaatggtagcttcagcttacaaactagtattacagcatgaccctgctttggtttaaatatgtgttgtgtgtgtgcacgcgcacgcgcacacaccccctagagagaaatagccctagtggtgaagcattctacttttggattatagaatttgagacattttaattttcttttggtgtgctttctctgcattttcccaaaattgccaccatgggtgcacatagcatatacggtgttatgaggatgttagactcaaggaaaccagctctgccacttgctagctgtctgaccttgggggaattacctaatttcttcatctgtaaagtgggaatagcgacagaacctttcttagaggtttgctccaaggattgtataaggtaacatatgtgaaatcctagcacggcatctggaatgtggcatgtgctcaggaaatgccagctagtataactggacaagcatttgtaactcgtgaaagcatgataccgtttttaaaaattaaaaccacaaatggcgactctcccactcccgggtgtggaaggagccctgagaagggactggatcatggctggctgaggagggctgagaggcctgagttccaactcgacctgcctgaaaatgcacaaatgactccttctcctcttgatcagttttctgactttgaaaaggatggtggtaaggggtggatgttaagtcctgctcctctaagcagaggccccagaggcctgacgatgatgctataactcagatctccaagaaggagctgatcgtggtcccacccaccccctttcctagctccatttcttccctgtgtccacttcctaatgtacctgctttgccccactgagacgtaaataaaccccaggaaccttcttcctaatcacacaggaccccagtgatctggggcaccttccccacatccagcctagtaatcagcctctcacccttcaaggtgggactcagcactctctgctaaatggaatcaccgttatctgctctgcttgtctttcctcctgggctgagaaagtcctggtcctatttagcaccataacttcagtgcccagcacactggagtgggccagtgatatctgttgactgcataaagaatgctgtaaaatatgatccagggcagtgccgagcagtgggtgggctcacagactcgagtgtcaggcaggtcagtgtttgaatttattattataattttttttttttttgagacagagtttcgctcttgttgcccaggctggagtacagtggtgtgatctcggctcactgcaacctccacctcctagattcaagtgattctcctgcctcagcctcctgagtagctgggattagaggcatgtgccaccatgcacagctaattttgtatttttagtagagacagggtttctccatgttggtcaggctggtcttgaactcttgaccttaggagatccacccacctcagcctcccaaagtgctgggattgcaggcatgagccaccgtgcccggcctgaacttactattgaatggccctgggccaaagatgggcctgtcctttctgagctttagtttcctcatctgcacaatgggtatgacaatggtatacccctcatagtctgacatttcagtaagattatccaggtaaagtattcagaatacctggcatatatgaaataataaatattactatcataatgagaatgattattaaaaatgtaaaatgacttggtggctatctccagaaaccagtttcagcactttcctttcagatctggttcgggtctgtggggtcagaagaactcccggacagagtgctccctgcacaaaaatgcccgactgagaaggggcacaagcagaggtacagcctgttttcccttacccagccgtgcaccctgctggcactggagaaaggggaaccttgttctgattcatcctcctagaggaggcagcgtttttaaaattcaaccaccaggatgggggtagggagagaagtgccttcctctaacttgcataaggatgccatataagcgctgtgtctggaccaggtcctcattatggggccacgagaggaagggccaccctgggctgtgctcactctcagttctaaggataacacaaaggcccctccaagattgtgcggcccagggcaggagtacaaatggaggacttcatacttattctaaatatgtaaaagtttaaatcaggctattaaataaaatatgttctatcttttcattctgacaaatatgtcttcataatgaccttcaaggccaggacagctcaaatttagaatcctccaagtgccacagatgaatgcggagggggagggagccaaccctcagccatggtccaccctttctccctctgctcccatatccagagggctcactctgcacatctgtgccggctgtcgcctccacaaacagcaccttcagggccaccctcaggatactgctgatggatgcatccatcctcaggagaatgaagccagggaaggggttgagacagaccctgaaagctgactcagggccatttgggcagggaatttcagggtccccacgtctagaacaggcctagaaggaggagttcaggtgggtaataagagtgaagccagaggcctgactggaggagggtcagagaacattccagtaatgctggcgacctgagatcagggccctccttgcccaggtctaaaggtagaaatgaaggctgggcatggtggctcatgcttgtaatcccagtgtattgggagaccaaggtgagaggattgcttcagcccaagagttcaagaccagcctgggcaacatagcgagattctgtctctacaaaaaaaataaaattagctgggcaggctggcatgtacctgtagtcccagctttttgggacgctgaggcaggaggatcacttgagcccaagagtttgcggcttcagtgggccatgactgagccagtgcactccaagcctgggtgacagagtgagaccctgtctctaaaaataaaggcaggaatgagacagtacccaattctaccgccagccaggtctgatattcaccaaatgggtcatgagaaaactcacaagaggtttataaggggtgattcctttgggaactgtggtctccaatttttaccaaagcctttcccaaatcaacagatgtaccaaccacttgggggtgaggtaggcatgaagcttctctcgctttcttccccagcaaggctcagattgaggagtcgcatctgtaggccccatcccagcctgggccttttctggggctggagacattcagaccccactcccaattcctgaccagggttgagttcgtcaaccattcaaacttagccttaactaaagagcggttttcctgtatttttttattttaattttttaaagacttagacatttacctctggagagaaattatgggcttcaagagttcttgacaaagagcttcgttccagaaatataaagccggcattttaaatttggttcttattcactgctggaaagtattagaatgaagattacaaatttaataatgtaacacggcaggaactggcctggccttgtctccaggagagtaatttgttcctgccttcaaaccggcacttcccagcctcccggcatcaccagaccagcctggtgccacactgctgactttttttgtctcttgcgcactggcccacgtggccagcccagacaccaggagatatcactatcctggcctgagaactagggatagatggtcagatctgtctggggagagccactataaccaaagggagccatctctgggtctcttggcttcactccttgcctgcggccagagaggtatttaaagattggcaaaccccaaatctgagtttgtcacatccctgctaaaaacccaagaggggttccaactgaccttaagctcaagcccaagagcctcacctttaaaggcctagtatcatccagttctgctacctcccaacaacatacccctttccctgggctttcaaaagaccatggcccactcctgcctcagggcccctgcacaactgctaatactaacaagagctaacatttattgagcactaattatgtaccacgcactgtgctaagggcttcacaggtgtcctctcacccctaccctgtaaggtaggcaatggagccaagtggcgaagctccagagcccaaagagctggacttgaattctgccttggaccctgtgtgatcttgggcaacttacctaatgtttctgtgcctcagtttcctcatctataaaatagggatagccagccaggcgcagtggctcacgcctgtaatcccagcactttgggaggctgaggcaggcggatcatgaagtcaggagatcgagaccatcctggctaatacagtgaaaccccatctccactaaaacaaaaaattagccaggtgtgatggcgggcgcctgcagtcccagctacttgggaggctgaggcaggagaatggagtgaacctgggaggcagagcttgaagtgagccaagatcgtgccactgcactccagcctgggagacagagcgagactccatctccaaaaaaaaaaatagggatagcccccaaaacaacctcacagagtagttttggggctcgaatgagtgaatggaagtgaagtgtcagaatgcaaggggtgccatgtgagccatggtaattatctgtatcggccttttacacagagagaaacagaagcaccaccaagtgaaaaataatgtggaacaggtcacgcagcagctaagcagagtgtggtctccagactctgaagcccttaatttttaccatgatatgcccattgtagaaaatctggaaaatacaaaaaaagcacaaactagaaagcaaaaactatccataattctgtcatgcagaagcaattatagttatttccatctgtggggagaggggagcgggagcgggagagacagccagagagtccaggattccatcccccttcccatcactatcaagtctgtgttcacagcatcctgtctcaccccctcccctcccctgccgtgccttcacttggccaacgctactcacacctcaggtctctgctgagctgtccccctccctgtgccccccacccaacatgtcagttctccctgctatggcctttcccagcaccctgtacttgtcttatatgcctctttatcacaggcatgatcggattattagttgcttcttcaagctgtgtaatgtccaacaacccccctcaccccaggaaccagaatgtaattccatgacaacaaagactggacttgccttaggtcaccagaacacagcttggccatgagcaactactggagaagaaagaaggaaatagagtggggaggaaggagaggagagagaaggggaggaagggaggggcttgggattcaactctgcctttcccaagtcagtgcccattggtgggatgcagatgggaatcacacagtccctgccctgcaggggctcacagtgtgacagtgaaaaagtgaaaagccagactgtgcaagcacaggagaaggagaaaagcaaagtaccacaggggctcccaggaatggtcacctccaccctagagaagaagggtgtgcttcctggaggaggtgaccctggagccctggagaaggagacatcaggcaccccagctgaggaaatggcctaagtgaggcatggagggagaaaactcaaacaagactgtcaaatatgaagaagctgggttttgcctggaaggaacaaatgcttggaagagctgtaaatatgaagtcaactaatctggctctatacaacacttgtttcctgtgttcatcctgtgcctttctagtacattctccaaatagtcaaacaagccattcctctgagctggagtgagcaatgctgtcattcctcatgtcctaaccccttgtcctagcccagtctcctattgccagcacctgcatttctctgcctgagggctaccacccatggcaggctggaaataaacaggcaataaccaactctctgatcttccctagcagctcttaaccaattactgatgggaactgctgtataaatacctgagctccctctttcctgggtgggataactaaagcgcgtgttctaccccaggagtctgcaaactatgggcctcggactaaatccatcttgctgcctatttttgtaaataaagttttattagaacacagctcaccctttcatttacatattgtctggggctgctttctcactacaacttcatgattgagcagttacaacagagactgtaatcctgcaaagactaaaatatctactgtctggccctttacagaagcagcttgctgagttctgtgctacactgtctccccagaagtccccagcaagactaaactccagttgcccttgcttgggttaacctgcctgataatacacagtctcctgacttctttctctgcctcactttctcactcccatcctggggtttcatccatcacctttgtgaaccatatgaagcatacaaaattctattagactgcttccactaataaaatggcagtttcaggtggtttgccctaatacttgtacttgattccttgtgtcaggctctgttctgggaaaacctaaactaggagagcagggcaagtgtcatcatgcccattttacagacgagccctaatttaaagctgttccctgcacacacattgtctcctcagcaaaggcagaggtcagccttggtttgagacccttcccgcactccccagtcagagccttgccatgtgtctttgatatgtgcagtatcattaaaccacctgtaggttacctcctgcttatagctgtgaacctgttcatctaatgaggaaatcaaagttcaaagaggggaatgacttgcccagggtcagttggcaaactggcagaaatgagatctcaaacccaggtttctttatgacaaatccagggctcatcccacgacaaatcaactaccccttctgctttcacctcaggccacctattagggcctctgccctcctctctggatacacggccaacttttcatgaggatcaggcaggctcaaatatattaaaatcctttgtcagacacaaaagacttcatgtctgcaaggtgcaaagtagaaagtcaggacaggcaccctccaaagagggacttggaaagaggcccacaaagaagcatgagatacatgtatatattcatgaaaaacattaaatacagtacagaatgctggaaagaacacaagtgttggaataggcctgggtttgaagtcctgttctgcccctcactagctgtatgaccttggccaagtcagaagtccatccagatgctcaatttctccatatggccgaatgtaatgactatgcccaccttgtggagggtgacctgaaacgagggttggacactgctgagcacagagctgagcacacccactctccccactctgtagtcaggggttcccagacagtgggtgagtggaccccactggtatcctggccagatcccccatgctaagcaggtcccccatcactcagctgccatgagtatctgctggtgccggctcacagctgccccatctttggacaactgcccttagctcataggagctgccttgccccaacagttatgccctcgggggactaccctgctataggagtaccgaagcctagtcaaccctgccatgccatccattctccagagctccccaggatctggctgaagttagcctgcagccaagtgcccatgtctggctgcttcttctcctgccccatgctgcgtctccctctccctctcttgcaggtttcacctgcgagcactcccacagagcacttgcacaaaaatccacttctcaggctaagacagtggaaacaggagtgaagagttctcctgattttctgtattcgttacaaaatcaagtgacttctggggaaagtccagagaagaaggtacatgttaaattctcccttgagccgggtgtggtggctcatgcctgtaatccccgccctttgggaggctgaggtgggcagatcacctgaggtcaggagttcgagaccagcctgcccaatatggtgaaactccatctctactaaaaatataaaaattagctgggcatggtggcacgcgcctgtagtcccagccactcaggaggctgaggcaggagaattacatgaacccaggaggcagaggttacagtgacctgagatcatgccactgcactctagactgggcaacagagcaagactccatctcagaaaaaaaaaaaattatcccttgctagagccacacacctgactcccctcagggcccagctgcccagtttgggggtccctctgcgaggacttagcatgcccagtagaagctgggcacaaatggtaagtttcctgaggccagatggctcgggggtggctcggccagggcttggatgggccccggaggcacctggtccagtcttggtgttgggcccaggctgatgaaagatgctgctcaagacatttgctgaggaactaattaattttcattagaggacccaattagtgagtgcagtgagtgtggtggaatatctttccacccactctcagggtgactccaggtggcgttcactagggacactgagtgctggagataaaggcagcaaacttgaggcctcaggtgccgcagggtccatgatggctacttggggtgcctcaggggacagggagagatcctgagctgtgtatccagaaacatcattgccacagacctcctgtgaggcttcaggccaattgagattgctctctgggcctcaactaagatagccacagtagatgacctcagagggactttcaactaaaataatgacagctaacactcttaagacactttcactgtgtaccaggctctctaccaatatttattcatctaatcctcttgacaccttcgaggcaggatggggctatgataagcccgttttgcgatgaggaaacaggctcagggaggttaagtgacttgctcagagtcacacagccaataagcggcagagccaagattcaaatccaggttatctggctgtggagctcgttactttcaccatgctatactgcctagtgcaacccaacttctctggaactctcacagtgcctggcacagggatgggcaccaccataagtgcttaataagaatttaaaaacaggaaaataagaaaaaactggtagcctgaaagagtgtgatggtggcttgtgggagtgggactggatagctgagtagaagggagatgccatttctttggatgtcctctggtgctgttcggcttttttacgatgtatctacattatcagcagtaataacagcataaagcattataaaagctgataacagtgcttgtaccagggatgggacatgaggatcagaagacaggggtgcccaggacacttcccccggatatttttcatgtgtttaaaatgttgtagcatctgcatatattacctaatccaaaaaaatactttaaaaattatccaagaccaatcaagcaaagatcagctagagagaaactggcaggagggggcgctctggggatgaaaaataaccatctaggggctaccgcagagtcagggggagacaaaggaggaactggagggcctgtacaagtgtcctaccttctctgggagactctgggtatatctaaaccaagcccaccagcctctcactctgcaggcagggatactgaggcccaaagagtcaaaaagtgggtgtaggagacactgagactcggcgatgaacaaagtccttctctcttcactcctcatgcagcctttcaggctccactgtgcacacagtaaacaccacatacctagaccagagcgaggaggcctgacgccagctgtgtgctgccccatcccacccttcctccacccagatgtgcacatcacatcatttttatgaagtctacaggaaaaggaaaggcggcagcttccatagcttggatgtcttctatgtgttgtacatacatcctctggaattctcacaaggtatctctaattccattttgcaaaggacaggctgaggcctagatcagttacataccacagtcatgatgcacagctagaaagggccagagatgcaaacccaggtctttgggcctcccaagtccgctcatttttactatcccaagccacccctcacagagggtatttcccatcagtttaggacaagtcccacccggaaactatttttaagtgcctttgtcttcagattctgagttgtatggggctgggtgagaatctcatcacatcaaggttggtcccctgcctccaacctgagctagaccccaatcttccctagaaaattatcagcgacccctttcttagaaacatctgaataaactgactcagtaaactcccccgggagcatttcccagcactttgccccctttacatcgatgattcctttgatttacttcttcccagtagaggtttgtcctcaaatgaacttcctggttttaacacatagccctcccttttcccaatgcagaaaagggaccatgtcctgttctctctggacgaaaaaggagctagacctgaatcctcagaattcccagagctgtctgggtccaatatcccatgcaatggtctcatggcctgatgcattgctcattttgactcacttatcctttgtacaaatgacttcctagaggctttatgagggcctacgtgttaaacctggcacaacgcaggcagcagctgagactcatttggatcatagactctgtgacagaaacaagagggcctgaagaccatacccaggactgaatttggtacccagtgtcccagcatctaagacatcaggagccaggagatatcccacgttggcaagaccccttcagttctctccagccttttcctccaacccagtggttctcaaggtagggtccctggatcagtaccatccgaatctgcatcacgtgggaacttgttagcaatgaaatcctcaagtccctcctgcccccaaactaaataaaagactctgggtgggcccagcagtctgcattaagaagccctccagaggattctgaggctcactcaagtttggcggccctgctctaacccatttaaactgacaacagccactgtgacaactgcagctgctaccaatgactgggaacctactatgtgccgagggttaaacatgcactctcatccattaatcctcatagcaaaggacaccttattccatacgtccagctctgggttaggtgtgttgtgtgcatgatgtcatttactccttactataaccctcttgagtatttactattattatgccccattttacagatgcggacattgaaccccagagggttgaagcaacttgcctacagtcatacaatttagaagtggcagtcaagatgaaaattcagatctgccggattccaaagctatgttctttctgtccgtccatggaagttccccagggtctctcacacctacatcatcagtctgggtcaggtgagattcgaagaggggtggaggcaggcagggtgagcagaaagaacccagcctggactccacagtgccttccagctacagcgtgaaaggaagctgcgttatgcatgtaaaggcacagccatctgcgcctaaggaacataaaaaacagggattcagggggcatgagttcttggcctctctctaacttcacccagctgggggccttttcttttccttcttcggacctcagttcccgcaccagataatctttatcctctacaaggctgagataatttgcccccttctctgatcttgtctctctaaccacactggtctgtcatctctagccacactggtctgctttctattccctaaaactcaaactcgcactgacctcagggcctttgcacagttattccctctgcctggaacactcttcctcctcatattcccattgctggctctttgtcagttaggctttatctcagatatcacctccttagccttccctgactaccttacttaacattatctcctagcccatcatcgttccattttcattccacttagcagaacctgaaattctttattgaattggttacctatttattgtctgtttcccccaccccagaatataactccctgagagcagaaaccatgtctgacttgttccttgatatatccctagcaccctagcacctagaacattaacactgagcagctcattaactactaactgaatgaacaaataccagaaaagaaaacctggactcagaggtcagagctctggatccttaatatgtgaccttggcaagccacttcgcctctttgagcctgtttccctacttgcttaatgaggaaatgggctagatgctctccaagggtccttccaagacttccagtcttggaaagccagacctggaagcagcccagctggtccatccagagaaggcagctggccagggtcctggcagcagctgccctctcgccacccccatccacatccctgcccagccacacagtcatctcactcccccgttgcagaaactgttaatgaagtgcgcactgctaaatgcagttacaattacgggggctaagaataaggcgctgacatcagcctcctcagtttccgagtgaatcagaaggggaggggggaggaaggaaaaaaggggaggggggatggcgctctggagctgtcaagtggaaatagcacagcgttaaatataatccagcactggcctacatcagtctggagaggcaggtgatggcttggcccccagggccagggcagacaactggattcttcaaggaggccaggcagccacggcagctgagggccaactgtgatagggatcaaccaggaaccagtggcagggaaggcactccaatgggtgggtggattgtagcagggtggtggaccctggtgggacacatcacacccaggcctttgtcacctgctgttctgacagcacaagcacagccccaggagcttacatagtcctgtcccacccaggatctcatttcatgcccagaagcagaagatggcctagagtcaaacacacctgggtttgaatcaccaccctataacctgagaaagtcatgaattcaactgctctaagctgcctggctttcctcatctgcaaaatgggtacatctgcaacagcagctaccccttcaggttgccatagaattcagtgcgatcacagaaagcaatgagcatggccaagcaagcccatcaatcattttatttttataatcctgagagatgcttgaacaaaaataattaaccctttttttccagatgaggctcaggaaggttaagagacttgcttgaggtcagagccagagcggattcaaatccaagcccaggtatctttccaatacaaaaaggcagtggaactgacgaggaatgcagaatgggagaaggtttatagtgggggagatacttcacccttttgagcacattcaccaaaagtggcacctttccagcaatttttaaaagacatgatgaaatgatggttgctacggccataaagaaaagacacagaggaggcaaagtagaaaaaagtccctcagacagacaagagggtcggctgagggtgaaggcttccttccattctcgctctcctccgcatctctcccttcacccccactcagccttcagttggaacttgctctgcctctggttctagcagggagtggggagggatgcagagccacatcctgaaagggaaacaaggtagatggacctctctcccccttcccaccaaacagaactaggtgggcctatggcagctgcaaaccgaggaagctggagccaggagtctaggggattggggatggggaagggggtgcctaagggagacagaaaataaggaaagagcactgattgcaccacagcagacctgcagaccagtgatctgtacaatggggtaaggcgtgaatcctcatgcacctgattttctaagatcattctttcaggataatttgattaaaataaagtggtctgggctgggcatggtggcgcatgcctgtaatcttagcactttgggagtccaagacgggaggatcgttgagttcaggagtttgagaccagtctgggtgacatagtgaaaccccatctctacaaaaagaaaaaaaaaagaaaattagccaggggtggtggtgcatgcctgtagtcccagccacttgggaggctgaagtgagaggatcacttgagcccgggaggtagagatggcagcgagctgagatcgcaccactgcaccccaccttgggcgacagagggagaccctgcctcaaagtaaataaataaataaataaataaagtggtttgcgtccacactctcaccccacccctctacttgaactatgggaacaactggttcaattctccatcatgcttcacttatccaaatctacaagagttctgcccagctctgaaaacattaagaaaatgggaaggggggtgtggtcaggaagaagtgagagaggaagtgtcctgccctggagggtgagggtgggagtggaggcttcaaagccgcaacttcatgcctccacgtggtcctgaccatgaaggatattttaaggcctcctccctcatccaccctgccagcctccttctagggctgaaggattcattcccaccatcttagagggaaggggtgagacagcaggacattttgtttcccagaaaaagctcaggtcaaatttcaaggacaaaagttagcacttggtctgggaaagaaaactctgccaaatggaataaagggggagggggagaactccagtgaggtcattccaggtgcctgggggtgtggagagaaatcggaactctgattctccctgccaggatctgtccggcaggatatgggtatcgccgcctcatcacccagaagtactcagaccaccccctacatttcccctctgtccaaaaatggggagcggggcgctgtggtactagtttttggatcccatccactatcccaccccgcccccagcccaacagatttggtctgagcggaagagggtggtgccaggaagggctttccagcccagagatgtggcccaaaccgctaggagagggactggtagctggctggtgttgccatggcaacctcctccctgcgctggatcgaagcttccatcctatgggcaaatcagagctggctgctccagcttctccgcccttctcccaggcgggagggggagaactggacgctgaaaccacttggtcaggctcaagaacaccaggctcaattccagaccctgatgtaacaaccccctttggcatctgttggaaacttgagacaccccagctccccagctaggccccaaggcagagtgtcagggctgggactgtagatgtgattggtgcaaatgaagtggtcaggaagagcagggaaccagtggctgaaatcctccccaccctcttgactggcaggcgagtctcccaaatccctatgtttaagccacttcaaagaaggagggcccagctctaccttaataactgtaatgatgcaataagattagcctattaaaattataaagctagcattttgagaatcagccttctcccctccccaaacccacagattcttttctacagtcatgttcagaaacaactctttctcagtaataagatagataacagctaacatgtagtgagagcctacctcatgccaggtactgtactaagacttctgcacagcacaaacagcataatggttgattaaaagcatagatgcttaagtcagattgcccaagttcaaggcttcattccctcacttcctggctgagtgaccttggatgaattaatatgtctgtgcctcagttttctcatctgaaaatggggatgttaacaggatagcagttttataggcttgctatgaggaatgagttaatatttttaaaatgcctgggaatatgtctcgcacaaaggtaatcatttgtaaaatgttaaccctatgcagtccatgttattatttttcttcttccttacagatacgaaaccgaggccacgtgtctaactcctccccgattacaaacccagtgccaacaaggctgggcaacaaaacacacacacaaaaaaacgcctccaagcacatgtttccctaaagccccagcatccttgtgaaagagggcaaaaggagcatctcaagaagtaagttcaaagtgcacgagggaagatgccccttgagaggaattctgggaaccagtaatgaccagcatcctgggcccacggcgggctagaaagaggtgtgaagaaggctcagcttcctgtgcccaccccaatggccaaggatcccaagtccaaatcaggaatgtgctctgccccagttaaggctaatgagaaaaaggctccttctcacaccatttctcaggaaactagcaaaaggatggcaactaaactctgaagatggctctggctcagtctagttggaaaaagatgcatttcaacatgagttggaagcagcaacaaaggggaggctcctagatgagccggaggcctgtcagggacacacttctgagacggagccagcagagacagacaggtattaagaaggccaggggagggaggggagaagaggcaggtagagccacgcctgtgtccagtatgggagagaccattccattgcttttagaaatcagttcagtgcagtgctgttctaaaagaataaatccaaaaaggcttcttttaggagaaaattaatgactttaaggagaacaggagaaattaagcaccaagacaacgctgcctacttctgactttcaccagacattcattatttttccggaaatgaaagttgactttctccctccccctcccaaatttgaagcatccctcaagaacagacagtgagcacaagatgcccaaaccaaactcttggtcgccagccgcacccccaggcctcctcacctgggaaacattttctacacagtaaggtctggatttcttaaaaatcctctttcagagggagggctactggtttaatggaaagagaaccataaacctgattttagtctcagctctgtggctgcctcactagatgaccttggcatatatatgtgtgtgtgtatatatatatatatacacacacacccattccagggcttcagtcacacacacacaaacactcacacaaatacacacacacccccatccatttgcgggcaaaaaggggatagacaagatgatttctaggtctcttccaagtgaaatactaaagaatttcaagaaggctgctggaaaaaacaaacatgagtggacctttaaaaatatcattaatactacttgaagttatctgttctgacttaagtgaaaccagagcaagttgcctgcagcctgcaataaccaaggtgtttgacccatgacacacagcatgactttgaagaaaaactaaaccgctcctgcctctgatgctcctacaaacccatgctcctgcccagcctggctcttgagatccaagtggactgctgaccactctactgtgttggggagccccctacttcttcccaccttgccttgtccagaataataatacaacctccctcagctacatgaaggcagaagttaaacctctgagcctcagttgtttttttctgtaaaatggtgattataaaaatggtaaaatgtctctgcagtaatcatctttacccttacccccatccccacctccaggtcaatagaaagacaggtctattggggatctgcctcacctatccccattcattcaccagtcaacaaattcttctggagaaagggcaggaagacatgcccaccacttcatcccatgatggaaccttggtggccaggttgatcagacaagggtccccaaagactaagtctaaacctgggcccaggaacttcctaaaaccgtaggctacattttgtggatggtgcatatatgcacttcgggagagatagtccatgttttcctcagagacttgaaagtgcccatgaaaccattttgctcctcaagcacatacactcctccagcacatacactcctctgttttgttcccccattgaattcaaagactctcggattttcaccttataaaacactgaactccaccctcacaccatacagagctttgcatcgatacgatgatccccatttcagagatgaggaaatccaggctcagaggtggcatgacttgcccaaggtcacagctaagaagtagagaatgaagactggaacctgattccgattcccaatctggcattctttggggaactctcacccaagccctctagctaccccacctgttggtggattcccttcctcaccccagaaccaaatccggagctctcatgttccttctgccgggtcccagggccctaaagagtaggtttccctacagctccccacccctcgctctggctgaggttgtgcgcaggcctgggaggaggaggttcaagccgctggctggtggccggcttcagcccaccaagaaaggcgactccagggacaagagcacctgaggtcaggggcacacaccagcgggcggacaagtgtagagttggcgccgccctacacctctctccgggaagagaggggaggaaaggccgtcacctggccggttcccctccgtctgccccaggcgtataagaagcaggagtctggagccccagcccatgagggaaggagaggagagataaatgggggcgctcaaggcctggggcgccgggcaggggtcttgggcagggatcctctggatgtggccaagacaaagatggagaggtaaggtctgcgcgccacctccaatggcggggggcgcgtcggagccccaggggtgggacggccaaagcccagggcttgaagagtgggcacattcaggagactcagggagggtggcaggtcggctccagggacgaggcaaggggcctccaataggcgcgggtgaggagggagatgggtcctggcgacccaaagggcccacctgcgggaaaggtgaatgcagacaatctcggggtccctgggggagaaggccagaaggtagcgcatcctggagaccctggggtcccgtgggtgcggaaggagaccctgggggcgccttcccaggggattgggggtggggaggagggcgcacgggtcggggagggggctaccggacctggatcccgggacaccccgggggtctggggggcgggccgcgcgcttacctgcgtcctcgtcgtcgaaggagttcatgcacgggaagtagatggcgagcgcctcgaaggaggcggacagactgaggcggctctgcgagcgctccatgcccgcgccggcgccgggcgcctcggccgcggcggcggcggcggcggcgggcggcttgggcagcttggccgccccattcttgacgcggagtacggcgcgcggcgtggtggcggcggcccggggccgggccgaggctccgctgcggggctggcgggcgcggcggggccggcgggcgggccaggagctggcggcgcgcggagcccgaggcgcgctgtgctgctggcggcggcggcggcggcggcggtggcggcggcggtggcggcgcagcgcgctctggtccgcggcgccccccgccggcagcgcgaggcgggcttggagcggcgccgcagccaatccgtgccgccgggggagggggcgccgctgcggggcgtgggagcccggagggcgcgggctgcggcctcttctagcagcccccgggcccggcaggtgcgcgcggggaggcaggcgccgggcgaggttgtctgggccctggtccgagggctgttcccgaccccgcctcggcccccaccctcagccggccgacttgcggagaggccggcgtccagtccctcacccagacaggcctctcccagagacactggcgcgctcggaggggatgcgctcaaagggtcccgcccaggcgggtcggcactcggcctcccacacagagaccctcggcttcacacctgcacccacagagaagctcaaacaggcacccacacctacacattcactctgcaacatgccccgcagacacccggacagatacacccacagacccaccccctcacagatgcggggacagacacgtccacggacacacgcagactcacgcagagacctgcaaacacactcagggaggtaggcaggacatccctggtgcccggcctccctcacggggagactctcagatgccacaaaaccccacgaagttcaggtaggcatacacagtctcatgcattcacacttaccaaagacaccccagaattcatacacacattcatacactcagatgaacacacaagcccagacccagcacacactctgtgtcgcctccccctgtgatcatctcagcactgtcaaacactctgactgacacggccagatgcacacaccttcaccctcagacacactagagtagcacacacacgccaagacacagccacacagactccatccctcccagtgtgggtgcatcccgacggattgactgacaccctcagactcaggtacactgagacacacttggcaggctcacactcacagactctcccattatcaccctcggcgacccgcagtcctcagacacacacgggctcagacactcacagccccaggacagagacgagcgaatcggaaacccgtgttccattccctgcatgtgacctgggacgtgagggtccctgcccacctaatcaggccccagatgtcaaacaaccttctcagctgctcgcacacctctttatgaagccatctggcgacatggaaacagttcaggcctcagaaagagacagcccagagtttgaatctcagctgtggtgctgtctttctgggtggcctatggcaaaactctttatcccatgggtcctgttcctcatctgtacaatggggacaggagccttccattttggatggttgtgaactgcctgtaagataacacaggtgtttgttttctattgctgcataacaaatgaagcagcttaaaaacaccaatctagtgatttacaatcctgtaggtcagaagtctgggcagcctgagctgggttctctgcttagggcctcacaaagtattggccagactgggctcttctctgcaggctctggagaagaatccgcttccaagatcattcaggttgttggcaggattcagttccttgtggttgcaggactgaggttcctgtttccttgctggctgtcagccagaagtcaacctcagctcctagaagtggctttctggtcctttcacctggccccttccaccttcaaggccagtttcaggatgtcaagcccttctcatccttcagtagaatctttctaccttggcttctgcttactggcctgagagattctgcttttaaaggtctcgtgtgattagatcaggtccactcgcatgatgtccctttgacatataatgtaatataatcacggtagcgattcctgatcagggtcgcagtttccacccatgctcacacaagggcgggatcacacaaggtattacataagggcaaggatcactggagttattctgacacatctgcccatcacagtgtgcaaaacacctagcacagtgctggccttcggcaggtgctcctgagccctagccccttcccagggaccagatctagactttgaggcagcctggtgtcatggttaagagtgctggtataatcatccccatcttggtcaatggcagctccatttttccacttgtttggatcagaaatgttggatacttgactccagtctcacacacaccacattcaatccatcagcaactcctgtcatttctatacacaaaatgtaaccagaaactgaccacttctctgccccaaaccctcccatctcacagtcaaagtccatgttctacaaggtcctaacttctttggctctgccacccctctgtcttcatacccaggacaccccggtggctcactcggcttcagaacatctgtactgctgttccctctgcctgaagccctctcccttgcaaagggctgtgtagctcactcacagatctctgctcaaatgtcactttccctctgaagtcttccctcaccactctttatgaagtagcaaaaacccctccctgaaatgccagatcctctctaccctgctttatttttctctgtagccctcatcaccatctgacatgtttcatatatatgtgggggggtacatgtatatatacagatacacacatatttatgtacatgtgtatatgcgtgtatgtatgtgcaaacacacatacatgtgtatatgcatgtatatgtgtatgtgtttgcatatatatatatatatacacacacatacacaacacacacatttttattcttgtttatttgtttatcgtctctttttccccttcccagagcccagaaagatgcctggcaaaaagttcgtgttctgtaaatagttgttgattgaatgaataaattctcacaccagccataggaaggagataggtatcctttgcatcctctccccatcttacagataaagaactgaggcttacgaaggggaatggacttactcaaggtcatagtgagtaggcctcttgtcaaaaatggtgggtgggggccaggtgcagtagctcatgccagtaatcctagcactttgggagggcaaggcgggtggatcacctgaggtcaggagttcgagaccaacctggccaacatgccgaaacctcatctctactaaaaatacaaaaattagccgggcgtggtagcaggaacctgtaatcccagctacttgggaggctgaggcaggagaattgcttgaacccaggaggtggaggttgcagtgagccgagatctcgccactgcactccagcctgggcaacagagcaaaaactccatctcaaaaaaaaaaaaaaaaaaaagtgggtggggaatctaacccaacataaggagatcgaagaaggcttccctgaggatgtgatgttggagctgaaaatagcacctcctatgtgcctggacttcttggtgtgatttctcctttcttggttagctcatgcctaaaattccatccatagggtttgggcctgtacacttaaatcatttaccctttgtaaatatgtaatgtttccccatgggaaatttaagtggtcagccacttacacctgggtatgaataatgcattctaagaacaagtttggggggtggagagggatgcttaagaaaatgaatgagggaagtggtggatgtggatccagagaaggaagggatgggaagtcagaaatgaacttccaggttggagttcacagtccagtgagatggaggatgccaagaaccaggcagctcagtggagtggagcggaagaagcattgcctgacttgggtttaaacgcctgtccttattttatttatgtgaccttgggtatgttccctcaaggttctcatcaaaaaatgagagtaatgggctgggcgcggaggctcacgcctgtaattccaatactttgggaggctgaggcaggaggattacttgaggtcaggaattcgagaccagcctggccaacgtggcaaaaccctgtctctactaaaaattaaaaaaattacccgggcatggtggcgcacgcctgtaaccccagctacctggaaagctgaggcacaagaattgcttgaatctgggaggtagaggttgcagtgagcagagagcacaccactgcattttagcctgggtgacggagcgagactctgtctccaaaaaaaaaaaaaaaaaaaaaaaaagggagagaataattaacacctctttgcacaattgtgatgaagattggagattggacatatacagagtgcatcgcatgtaataagtacttgatagataaatttattgcatgtaaattccaagtgctcactattgtacccagctctacaaatacagggatgaataaaacagacctggtctctgccttcatggagtttatagtttggtaacattaaacaaataattatgctaataattatttaaattatttaattactaccttatctaatagttgcataataataattttaattgcaattgtgataagtgccataaaagatatatatctatatactgtgtgtgtgtgtgtgtgtgtgtgtgtgtgtttgagtgagatagggcgagatggggtcttgctatgttgcccaggctggtcttaaactcctagcctcaagcagtcctcccgccttgacctcccgaagtgggtaggattacaggcgtgcacccccatgcccagcccagcatgcatatacgttgcagtgcatttgtgtacatgtatgtgcagcttcaagtgggtggagagtctgacccagcatgaggagagggaagaaagcttccctgaggatgtcatgttcaaaatggcacttcctatgtgcctggactcttcttggtcctgttcttggtcaaacttgttcttagaacacattttacttatttatatcggtaactaaaccaaatcactgccctcagatttgcatttgaaaataactctggggccaggcgcagtggctcatgcctgtaatcccaacactttgagaggccaaggcgggtgggtcacctgaggtcaggagtttgagaccagcttggccaacatggagaaaccctgtctatacgaaaattacaaaaattagctgggcatggtggcaggtgcctgtaatcccagctcctcgggggagctgaggcaggagaagcacttgaacccgggaggcggaagttgcagtgagccgagattgcgccactgcactccagcctgagggatacagcaagactctatctccaaaaaaataaaataaaataactccggggctgctctgagagggatggatttgagtgaattcagagagtgccttgccccttctcttcaggtaagtcctgatttgaaccaaaaatccattgcttgtttttttgcctcctagcaaaggaagatggctgagaaaggatgtcccggtggaaaggtgaagtggaggagtctgagtgacaaagggtcctatggccggataggaggccatggctgggggaggctgagacatggatgggaggtaacaaggcctcggctaaggagagggctgggcctgaaagttccagagatcacttgagcaggacttggtgacagactggatggggtgagggttgggaaggaaaaggaggaacaaagacactgccaagctctgagcatcaagagaaacagcacatacagatggagccctcctcttcagacacctttccctaagctgaagccttcaagggagtgccccttaaattttacatattttgcaagacccagctgagtggctttcagctagagaagtgacaagtggctggaatgtagttagttaaacctctagggggtcctatttgcagttttgtccaagagagaaagaccgatcttgtctgtgttctgcctgctctgtgtgtgtgtatgtatgtgtgtgtgtgcatgtgtgtgtgtaaaactcccctgctaatgtgcatgcctctgatagataagcatttctgcatatctgtgtcattgtctttgaggcaataaccttgtttctgaatgcatcctttcaaggtgcatgtcctcgtgttaaatgtgtccactctagctttgaatgtgatatgtatcctggtctttgcatgtactgatatgtgggtatgtatgtgggtgaaagacataaacagacacacacaaagacagagaaagacagtgcctgtctctgtgtgcacatgatccatgtattcccgtttccatgtggttctgtgatgtgtttgtgtcttctgttgatggtgtgtccttctgtgtgtttgccttatctctaagtgtattggtgtctatgtgtaactgagttgagttagccgtattcgagtgtcggtgtaaggtttctgtaatgcctacgcttgtgtgtgtctctttgcatcctggtcagtgtgaatgcatccctgacagtgtgtgaatgttgctttgtgtgaacttgtccatgttgactggtagcttgagaggggactcatattttcttggattaatctcagtctttaagtggctaacacatgccttagagctaatagggatagagatattaaaatctgttataaactccaaatcccctaactacttacctaaccattaatttattctttcatctacccatccatccatccatccatctctccctccctccctccctttctccctccctccctcttgatttcactggcatttagtaactatgtagttatttctcttaggcgtgagttttctcatctataaaatggagatgataatgtagctacctgatagggctggggatatggggtagaaatggaagtgggataccacatataaaatacttaacgtgttgcctaacacatagtaggtgctcactatattaacgattattgtcacatcattgtggtcactgtgattcagcaaattctcatcagcactttactaagggccacccctgagctagaagctggtgaggccctatccatagcagaggccattaagtgcctctgcctcaccttcttgtgtgacctgggacaaagcctatgccctgtctgaacccatagagtgggtagagcactcttgccccaccttcttacagagattctgggggcatctgcacttctgaacctgcaaggagctgtgcagttatgtagcaggtcaggggacattccaaagccttaaaatggcagaggcctgtcctgggtcatcaagagggtcaggcagagctgagacaaagccagaccccctggcacttcaggccaaagccagacccactggcactgacaggccaaagccagacccccggcactgacaggctttcctgtcatttctagtccttgttctctctctggggacgcacctatcgggaagccatggagcagagcttcttcacttctccaccatttgtctctcacttactatttagtgaggggcctggccttatttttaaaagaaaaagaaaaaagagaactaggtagggggtgtgatgtccacctcaataagccactactgtggacaagagacagacagagacagagaaagaaggagagaaagggtagaaagagacagaaactaagaaagagacatggaacactaacagagagacacaaagagacagggaatggaagagtcagaggcagaaacaggagagagggagggagatggttggagacaggaagagatcagaatgaagtcgggctttcttgcagacctgatttgggctgccccaatttacaaagctgtaagagccctgtagcaaggactgccactctcctcaggccaccttcatccaacacacacatgtactcatacacactcatacacacattcacacactcctaaacacactcatcctccaatgctcatatatgcatgctcacaaaatggaggaagaggcaggggcctcaaagtaggggtggattctggtcatcaagaaccccctgtgtgaccttatgcaatgccaagccacatcccatttgagtctcagtttcctcattcggaaaataagcccgcagacctcactcagtggtttcaaagctaaaggggataatggatgtaaaaaagttttagaaataatggaaaagtctggaaaaggacctttggaactaggcaagctaattatacagctcacatggaaaattgctgggaaaatgtgcagttgaggaaagtggggaaggataatgagtgatcaggagccctatcaaatcccaaaacattctaaaactacagtaagtttttttgtttggttggttttttttgttgttttgttttttttattttttagacggtgtcttgctctaatgccagctggagtgcagtgacgcgatcttggctcactgcaactgctgcctccctggttcaagtggttctgctgcctcagcctcctgagtagctgggactacaggtgcatgccaccacacccagcaaatttttgtatttttagtagagacggggtttcaccatgttggccaggatggtctcgatctcttgacctcatgatccgccagccttggcctcccaaggtgctgggattacaggcatgagccaccatgcctggcccagtaagttcttttaaaggccaaaaaaagttggattcccttcatatataaagagcacttacaaaacagtacaaaaaaggccatcactcctgtaggaaatggagaaaggctcttaacaggcaattcacaggaaaaaaaatacaaatgacatctaaaagcaaaaagttattcagtatttctcactattaacagaatgtcaattaaaacaaattatttacccatcagtctaacaaagaaattgcttgaaaataaactgtatggggaagggagtggagaaatagacacagtcacacattgttagtgggagtatatattaactgatgaaaattttggagattaatttgttagtatctatcaaaatatttaaattcacaaaccataacttaacaattcaccgtttgaacagagcaattccacttctaggaatttattctacattttacatatatacttgcacatatgcaggaagataatgtataaagaatgttttgtagcattgtttataatagcaagggattgaaaataagccaggtactcatcaaataaactatgatacatccatatagggaaattctatagtcattaaaatgaacgaggtagatgggtttgggacagatagcctagatatataatgaaataagaaagcgatgtctgaacagtatgtatagtgcactcccatctgtgtccaaaatacatatgtatgtaggtatttaaatataaatctttgaatgggcacacagatttcaggagccatacacaggaagctattaatgatgatttccttaggtacataagactgataacttctaggtagtagtcagtgtcttttgctttatgcccttctctagcatatgaattttttttttttaccatgagcatgtattgtttggaataagataattttaagtacattttttcacctaaaaaaggagttagtatccatagttagtaaataattacagtgtaaatgtgttacttgggccaggattacctacaagcttcctgttatatatgacttcagtaacatggattaggtccagaatcccccttgggaccaccctcagggtgggagcacgctttgccgccagtctcctgggaatgagaaagtaggctaggctgcccaaaataaccacctgccatttcccaagctggtcactttctctcctgagccaagggaggctctggttgggtggaaaaggtggatttgtctttccaggaaccacaacctttttctatcgcactcctcctccccctgaccaagcaaccctgacatctaaacctgtcctttgatgccacccagcccggaaggagatggctggagtctagaaacctagtgcaagattaaaatctgctctgccacaggtttatactgtgatcttggggaagccactctctccctctgggcctcagcttccccacatgtcagaagggggatgggataggatgattgctgaaagccctcccaactctgacccatttaacttaagttagatagtcatgagttcaaatctgacctctgaaagtcactagctgtgtaccattgggcaaaccacttcacctctctgagctttaatttggtcatctataaaacagagaaaataatatacttcatagagtaattgggagataaagtatataaagcattaaaattgtacatagcacatagtaacatctcaacaaatggcagccatcatcatcatccagagtcttacttggacctggcccctcagaagtagccctagtttaaggacctttcccactcatctcccaacctgtacccaacagctcttctgccctgggagggccatgtgctctgacctaggaatcaataagcataaaaccttatccttgctactgaattcatatggaatcacgcgggtgcagtggctcacgcctataatcccagcactttgagaggccaaggcaggtggatcacatgaggccaggagttcaggagcagcctggccaacatggtgaaaccctgtctctactaaaaatacaaaaattagctgggtgtggtgtcacatgcctgtaattccagccatatgggcggctgagacacgagaatcacttgaacctgggaggcgaaggttgcagtgagccgagatcgtggcactgcactccagcctgggtgacagagcaagactgtctctaaattaattaattaattaattaaatgaattcatatggaatcataggttaatgtgtggccccatccaaatcacccatgaatattataattgattaataaagactaaacctctgggatggtcaggaaaggctaatgggtgggaaggattttgggacaggggcctcttggaattcaactgggcttcatttgcaatatcttttccaggaggggtacattccctccaggtactgtgacaagcctttaagattcagggaaggtgtgcataaagagagcttttgatgctgcataaattatgttactgcgatcacctccacatggaattgtccccagtagaaaaagctggatgttcctccacgtttctctgtctccactcccacagacccatcccaacttaataccaagggagtgggctcaatctccttgctgtgccaggtacctatctttaatgctggctttagtgtcaacttaggcctcagattccccagctttacaaaagaggcaggttttttcgttttgttttttgttgttgttgtttttgacagtcttgctctgttgcccaggctggcgtgcagtggcacaatctcggctcactgcaacatctgcctcctgggctcaagcgatcctcctgcttcagccacccaagtagctgggactacaggtgtgagtcactacacccagctaatttttgtatttttagtagagacaggatggggtttcgccaagttggccaggctggtcttgaacccctgacctcgaattatccacctgcctcagcctcccaaagtgctaggattacaggcatgagccaccactcctggcctacaaatttctttttttaattagccaggcatagaggcacacatctgttaaatgctttttgtcaccaaaagcctcctaatgactagacccacctgctcacctgactatcttctggcccatgacctctttgacattctcctgcattccttcaataaaaccccctcctcgttttgtttcttgaaaccaaataaccccacacccagccagagcttttccaagcaacccctgcgtatagattttcatggcaggcatctttgattctgatttggagaagaaagtagcaggcattaggaagaaatgtagggcaggctgtggatcgtggacgaaacacatagggcagaaaggtgaggtagtggtggcatctctccagccttgtgcctctaaatcaggctgacacacaccatggagcccatggatagtattttttttttttttttttgagacagagtctcattctgtcacccaggctggagtgcagtggcacaatcttggctcactgcagcctccacctcccaggttcaagtgattgtcctgcctcagcctcacaagtagctgggattacaggcacctgccatcacacccagctaatttttgtatttttaatagaggtggggtttcactatgttggccaggctggtcttgaactccaggcctcatgtgatccacccacctcgagctcccacagtgctgggattacaggtgtgagtcactgcgcctggccaatagtaatagttagtgagcatctctgagccaggcatggttcttgagccaggcatggttctaggcccaggaactcagaaaatacccagacagacagaaatgtctgccctcatgaagcatccttacctagtaaggataaacagacaatccatttatgcctagtgttccattattggaatgctaagcttgtgggagttatttatatcctactgctcaaggtcatcaccaagatctgatttttcacacacacaaaaaattgcaacctccggcataaatgggttaagaagagaaacaagtagaaattacagtgttttagatgtaagcgctgttgggaaaagtatataaagtagaggaaaattgggaggtgtctataatgctgtgcaggatggccaagaaaggcgtcatgagatggtgacagtcaagtaaagacctgaatgggggaggattcctgcagatgtctggagaaagagtattacaggcaaagggaacaacacgttcaaaggccctgaggtgtgggagtgcccctcatatgtcagagaattggaaagcaggccagggcagtgagtgtagatgactgaagggcaggtgggaatacaagaagttagagagtaatgatggaaaggagtggaaaaatgatatagtccttcttgatttgtgcaatattcttttttttttttttttcttttttggagacagggtctcactctgtcacccaggctagagtgcagtggcgtgatcttggctcactgcagccttgacatcctgggcccaagttatcctcctcatccttgtgagtagctgggactacaggcacataccgccatgcccagctaattttttaattttttgtagagatggggtttcgccatgttgcccaggctagtctccaactcctgggcacaagcaacctgcctgcctcagcctcgtaaagtgctgggattataggcttaagccaccatgcctggccatcaatttgtgcaatattcatatgccataaatattattattttgttactgttccttaaattggtttgctttttgttcggatacatttgaaatgaaaattttatatcactactataaatgaaggacaagtatcacttgcaacaaatagaatgtaaccaaataaataaatacaacactgaaacaattattaaattatagaaagatgcggtggcctgtaggaggcttaagtctgattgacagtcttagagaagtgacaaggcatactagcacccgggtcctacttcatgtgccaaggggcaaaaaacatactagcaccaaattgggagtttctctggtatggtatttagtgttacactatagaaaatcatctcacgtcccactaggcaggatgaccaaattgttgtggtttccccaggactgaggggtttcctgggatgtacttttactgctgtaactgggtcagtcctggaaaaaccaggatggctgttcctcctatcaccagcagtccctctcccaccctgtagtctaagaccatctgccttcagcttgcccttctctacgttgccctttgtggtggctgactctaaggtgatccttacctcctggagttggtgtacctgggtcattccctccccttgaatgtaggtaggacctgaaacttgcttcttacccataaaatatggcaaaagtgatgggatgtcacttccatgattagattccacataagatggtgacttccacattgctaactcctctctttattgccttctcaccttggcaactctctattgccttcctagcttgcatgatttggtgaagcaagtagctgttctgcggggcaccaatggcaacctctggtgagcagccagctaggaagtaagacccttagttcaaaggcctctaaggaaccaactgttgccaacaactgtgtgagcttggaagcagatgcttccctcatcgagccttcagattgagacccaagccctgactgatgcattgattgcagcctcgtgagagatccgaaagtagagtgcccagctaagtctgcccatagttctgatccacagaaactgtgagataataaacgtgtgtgtgtgttttaagccatttaagtctatggccatttgatactcaggattactaatactaaaacaccctttccaaactattgcttctctgggtatattagtccgttttcatgctactgataacgacataccagagactgggtaatttatttattattaatatatatattttttgagatggagcctcactgtgtcgcaggctggagtgcagtggtggcacaatattggctcactgcaacctccacctcccagattcaagctattctcctgcctcagtctcctgagtagctgggattacaggttcgcaccactacacccagctaatttttgcatttttagtagagacagggtttcgtcatactggccaggctggactcgaactcctggcctcaagtaatctgcctgcctcagcctcccaaagtactggcattacaggcatgagccactgcacccagcctggactgggtaatttatgaagaaaaggaggtttaatggactcacagttccacgtggctggggaggcctcataattgtggcataaggtgaaaggcatgtcttacatggtggcaggcaagagagaatatgagagccaagcaaaaaaggaaatctcttattaaaccatcagatcttgtgagacttattcactaccatgagaacagcatgggggaaactgcccccatgatttaattatctctcactgggtccctcccacaacatatgggaattatgggagctacaattcaagatgagatttgggtggggacacagcaaaaccatatcactaagtcctgattatttgcacggctcatttatggaccctgatgtcttgaggctattgctcagcttcctacacctgaccctcaaggaaccctcccctatttcattctggctgcccccagctgaggtggacagtagctcaggtttcccttggtagacagagctcagtatccctacgtgaggggatcttcactccaagcccaacaaacaggagaatgatgggaaattaaggcctggagatgttggagtccaggccactgggcaagctgcctaaaggaagtagggctctagcctctggtctggggacagggacaggactctccacttttaactgctccctcctggccatgccccaaactgcagagcccgtataagtcaccattacaggccatctgttctctaggccttgcttctcactctccctgtttccaaccttcttgcccaccctgttggttttgtgcctggttctcttttcttagcctagttccatccatttgaaaaatcatctggacagctgcccagatgcccaatttgcaaatcaaaataaactaattttattacaaaaataatttttgcacattttaggaaagttagggaaaaaattaaaataatcacaaagaaaaaaattgaaaatcacataatcataccacccagaaataaccacttttaaacctgatgtatttttttgaccatatatgatatacgaatatttctaatggtattatactataagtgcttttatggcctgtgttttgtttatttttccacttagctttctatcataaacatcttctcacagcaataaaaatacctccatctcatcgttttaagtttctgaacaacagctgacataatttaactaatttctaatgttggacatttaaattgttaccagttttttgctgtcatgttaaagtttaaagaaatacttttgcaattagattgctgaacacatccatgacttcactagcaggacaactgctgggtcaaaatgttgcatggtttgaaggcttttaataagttttggcaaatttcctctaatgacattgtaccaatcttcactctccaggagcatatgacattcactctccaggagcatatgacattatttcccatcctcattctctaaaactagcaattttctttgtgattctgtttttcatggtctgccatcagcaataccataatttctttctttttttttttttggaaatggagttttgctcttgttgcccaggctggagtgcaatggcgtgatctcatcgcaaactccgcctcctgggttcaagtgattcttctacttcgatcaagactgtttttgagatttgcgttaaattatataactctattcattttaactactgttaaattttatcttcatttttaaaatttgttttcagactaatgtaacttgttgctatccttgtgctattataaacaatgagttaatgaacatcttcatccctgtatctttactagggtttctatgcagaagtggtttgctggttggtaggttaacattgtttttcaaactttttttattgtgacctatgataataagcacattttacatcacaatctccacatacacaagttaaaacaaaagtttcatgaaatagcccttatctttattactagaaatgtattctgattcaacttcctttttaaaatgtcaattacaactcacaaattgattttacaacatagtaatgggtcatggcccacaatttgaaaaatgatggattaaaatatatttggtttcactaaatgctttaaaattactctttagggtagatacactaatttacaagacaggttatcattgccctacaccctaaccaacacctgattttatatttttttctttttgccagtctgatgtgtataaagcagcatgtcattgttattttaatttttctttctttgatgctaataagttgagcttctctttatatgtttattcactaattgagtttctcagagagtgagtttgcctattttttgtattgggttgccaggtttcttcttgctgatttactgctgagtttcttatataatttagattttaaatccttttattgttattgaaaatatactgtaaatacctttcccagtctgttgatcatttgttagctttgtctgtgttgtcatttatagagcagaaaaccaccaattactttatggtttggactttttgtttcttacttaagaaatgtttccctaacccagtgtcataaagatttgcctataaacgttttagcttcttaaactagctgaagtttgttttacatgctgtgagataggatctatttttattttttccatacaaccagatattttccccaacaccattaaaataatccatcttttccttactgatttctgttgtcaattctatcacataccaaacatccacatacacagttctgtttctggattcttctcttttgtcccactagtccacatctggtagggtgatccccatctctgctcttaattttgaaaatagttcttttagctatttatggaactttattcttccatgcaaactttataatttgcttctctaattcctctcccccaaatatttggtaataattacatgaattgacaccattacactgctatttcttaccgtctacaaacagtacatttcttcatttacgcaggtcttcttttatctcctttgataggttttctctaacatgtttggttaattctagataactcattttcttaatcttctttttttctcctttaaaaaaatagtctccaatttcatagaagggaatagtatcttcttcccaaacagccaagttttattatttttttgtttgtttgtctgtttttttttgtttgttttttttttagtagagatgggggtttcaccatgttgaccaggctggtcttgaactcctgacctcaagtgatccgcctgcctcagcctcccaaagtgctggggcgtgaaccaccatgccaaacaaattattattatttttttagaactcaggatcttgctctgttgcccaagctggagtgcagtcgtgtgatcatagctcactgcagccttcaattcctggatgactcaaaggattctcccacctcagcctcccgagtagctgggactataggcatgagccatcactcctagataattgacttaaatttttttttttttttagagagagggtctcattatgttactgtggctggtctcgaactcctgggctgaagtgatcctcctgcctaagccttccaaagtgctggaattacagacgtgagccacagtgcctggctctcagccaagttttcaataccattcccttcatgacactgcctcctggatcacctctttagtaagagatgaacccagaaatccagaccctacacaaaccaaacagaaccagtaaggcactagtcagatgggcacctatagaagttgttaaagcatgttggggactctaaaagaattttagaaataaaatgacatggagaaaattatattaacctgacttattctcaaggctatgactatacgtatttgaaggtgatatagttgactcttgtactttgtcagggttaggggcaccaacccctgtgcagtcaaaaacccgaggataacttaactccccctaaacttaactaccaatagcctactgctgaccacaagccttactgagaacataaacagtcaattaacacatatttcatatgttatatgtatcacatactgtattcttacggtaagctagagagaagaaaatgagctgggcgccaaggctcatgcctgcaatcccagcactttgggaggctgaggcagaccgatcccttgagtccaggagcttgaaaccagcctgggcaacatgacaaaaccctgtctctataaaaaaaaatacaaaaacttggctgagcatgatggcgggtgcctgtagtcccagctacataggaggctgaggtgggaggattgcttgaacccagggaggtcaaggatgcagtgagcagagatcacgccactgcactcctgtctagacaacagagtgaaaccctgactcaaaaaaaaaaaaaaagagagaaaaaagaaaaccgtaagagagacaaaatatatttaccatactatacttattgaaaccataagtttatgttattgatttacaagaagaattgtctgcctgaaaaggcaagcaacctcagctgcagacctcaacctatgatacatatcaagcaattccactctttcttataatatcacaatttttctccacttcttgggagtacttcctgcattactggtagcacttgttatgggtcccatgatgtcattcaaggtttatggcattgcactaaacacagcgaaaaatacctaagaactttgtgagatcactttttactgccacaggcaatttactggagagatgaactgctcatgaagagatgattagcagcacacagcgtcttaagtggaaacttgcaacccttgcgctcacagcaatagcaacaggaggtggctacgaaattattacagtagtaccgtatgtgctatggttttttgtttgtttgtgcttttttcaagacagggtcttgctctgttgcacaggctggagtgcagtggtgtggtcatagttcactgcagccttgaattcctgggctctagtgatcctcccatctctgcctcctgagtagctaggatgatagtcatatgtcactacacttggctattttttttaactatagttaattttatgcaattatgagttaatactgcatcttcacatttgttcacatttctcttaactgtgaatggcaccatgcaccatctgtttgcgtaagttttgatgaattttaactttttataatagatgtgtgtatattttatggtggtaaatgataacaataggtaagtatttgcatattttcatacgttgatgacatatttcctttttctttttttgatatttctaaggtgtgtttcatctgcaggttttttcaaattgtcacaaatcttcaaagacatttcaatatatttattgaaaaaaatctgcacataaatagacctacacagttcaaacctgtgttgttcaggggttaagtatacttttaaaataaatacttggagtgttggagaagggaagatgatgttaaactgccttctaggaagacagctatgctttactacaggactctagtttctttaagccagtaatgcaagtttggggccagagctgaattgcttgtaatagatgatgcaaagtattgtcacaagagatcttccttcccagttgttccttcatgcatgatccagcttctcttctgaacaaatgttgagcaaatgtttatttaaaggaaaaagtgacactgatttcttagttgctctgggcatctgcatatctcaggttggcaaggggtcttggcagaagcccaaacctagatgagccataaaatcaggtagacaccaaggtgacaacttggggcagggaccaaggtcagagccctgtcacaggaactgtggaacagacttcttgaattgggtagtggtccagttattgaaacaccagcccacatcccaacagaaaaaacagtaaaatatctgtctaggcaaatttccaaatgaagaaaaacaaatagcccatatgaaaaaaagaagtgttcagcctcattagaaaataaaacaacaaaggatattttttttccttgtctgattggcaaagtttcttttttcttttccttccttccttccctccctctcttcctccctcccttcctccctccctcatttccttccctccctccttccttccttccttccttgcttccttccctccttccctccttccttccgatactcattgttgagggagtggtgaaagggtattctcaagcacagctggtagttgtgtgagctggcacggcttttctggagggcaatttggcagactgtatttaaaaattctaaagacacgcactgtttttgatcccgcaattctacttctagggatttctcctaaggaaataattagaagtgaatacaaagatgaataatagcagcttaacatttacagggtgttcactctgtgcaggcagtatgctaagcacttacacttaactcatttagcccttatagcaacatgcaatgtgaggagtattgtcaagtccatttttaggtggggaagctgagtcccaaggaggtggtgtaagttgattaagttcaagtagctagtaagtgacaggatgctcaaatcctgatctctttaactccaaaacccattctctgaaccaccttgttatcctatcctctggaacactaagtgtaaaaaagatgctctacatagtaccgtttaaaatggcaaaaattctgaaataagctaaatgtgcaagaattagggaacattaaataaatcatgtaggatcatatgataaaatacatagtcattaaaaataagttctaaaacaacgacaccaggaaatgttcatgatatatcaaatgggtaaaataatgtataagttatgtcccattttaattttaaaaatgcatatgtaccatttttatgaagtttaaaaataggaaagaccagggtgtaatgatcaaggttggaggggaaaggggtcgtcgactgggaagcctgctgggttgcatggatgtttacatacataaaaattaagccagtagtgcagttaacatttgtgtgctttatacaagtttatgtaagttatatctcactttaaaaatacataaatgcatagaaaaagccctggccagaaaaacaaaaacaaaaacaaaaaaacaacgttagcagtgattgttgctaagtataattttcattttattctttatactattctgtgtatgtgtgggctttttttattttccatttttttgttttgggggttttctttagagatggggccttgctatgttgcctaggctggactcgaactcctgggctcaagcaatcctcccgcctcagcctcctgagtagctaggattacaggcatgtaccaccatgcccggccttctgtgctttccttcccctgcatttcccacccttccaatgagcctgtattatcttattcttgggggctgggggagaacatgcacatgacggccaggctgtagtccagacctagaaccctggaggtggcagagcttttcaaggactccagtgctgggcgccaacctgagtctagtcttgcaggtacaacacagtggttccaaggatactgagaatggtgaggtccagtggccagcctgtttggaggatatgcgagtgagaatccctgagtagccttagatgaactagaagcaacacccttaagataagttcctccgactttaaaattcagctgggcaaaggctgcatgtagccatcctggccacggagccatcctggtcacagcaacaattcattgttcagctgctggttggatgccttgttgctcactggtgatgacatcaggtctccagggagcacactggctgtcaatcagaagcctttttctggcagcagtgagccatctctgcctcctctctcttttaaaggggcagcttctgcctgggcaagggagctaggtttgggccaccttgattctttctttccatttcaagtctaatttccagggcagtggagatattaaagaagagcaaggtgggttactgtgggtgtttctcaagatcccagcttcagcttactcctgacaataaaatcttgctaaccaagacatggatcaaaataaagatggagctaaaaaattaaaatccagtggatataaaaaatttcactaaatgtttttagtggatctaaaaaaattatattttaaaaatctttggtatataaaattgctggtaaatactaaacaggcttaaatataaaatgaagaaaaataactgagaattatcagttatttccatcttccttactaagaaatactaatttgattgaggccatcaaatgtgcctagttaaaaaaaaaattcctcatttcctagcttctgttgcagctaggggtggcatataacacagttatggtcaatgaaatgcagactaggaatttgcagaaaactttccttttctgatttagtcattctctcctttttcctgggtggaataagaacatgatggctggagctttagcagctgttttgcaatcaaaaggaaaatcccaggagaattacacagacccttcaaccctgacatccttgaagcagtgaaatggtgacggcaactgcctaactcttcaccacttgtttatttaagacactggctactcaggctttctgtaattcatggctaaaagcaatctttttttttttttttttttagatggagtttcgcttttgttgcccaagctggagtgcaatggtgcgatctcagctcactgcaacctatgcctcccggattcaagcaattctcctgcctcagcctcctgagtagcggggattacaggtacgcaccaccaggccccactaattttttgtatttttagtagaaatgggctttcaccatgttagccaggctggtctcaaactcctgacctcaggtgatctgctcacctcggcctcccaaagtgctgggattacaggcgtgagccaccatgcctggcagtctttaactgattcactccattgaagtaaaaataacaacacagtaaaacgggaagtttggggagaaaagatggaaagagtataacagtgccagtgttttattacatgtagtcaccatctaaaattgatatataaggctaaaaacaacaatgtctgcaacctcttaatgttttcaggagggatctttaaggggctcatatatttcttttggtggagaaattgttatctaaagttcataaattctttctttacatttgtttctaaaattccaataaattcaagtaaaataagtgaaatacccttcaaaacttaagaagagtattataatatgaaataatttttagaaattatttctgattacctatctgtatagatgcattgaaagatgtttggagtgatgttcacctcatttgaattatgctcatttccggctttttatttttgtttttaaacttttaattttgaaatgattgtagatttacagaaaagttgtaaagatgggaaagttctgatttcctcctcactcaacttcctctaatgtcaacatcttatgcaatcatgctacctgtataaaaagtaagacattaacttggtaattattatagtatgatgctgttaaccagaatacatacttcattcagattttctaatttttccactgatgtcttttttatgttccactttccaaaccagaataccacattgtgtttagatatcacatctccttcgtctcctctggcctatgacagttgcttggtttttcctttcctttcatagccttgacacttttgaaaagtggtggtcatatactttcagaatgtttctcaattttggcttgtctggtgttttctcatgatttgactaaggttttaggctttggggaagaaaaatcacagaagtgatgtcttgtcatcccattcattacatgaaagggcacgtgatctctacatgacctctcactggtgatgttgaccttgatcatttgactttttcactttattctttgtacttttttatattgctttaattccttataatgagtatgtcataaaagggaacttggaagtgctacatatgctgaagaactccacaaatgtgagggttaaatttttcatttgaaagagaggattgatgtccaaggcttggctgaaagagggaagagaagataagtatagctacgacatcaatgttaattgcctggaggccagccagggtggcagggaaaaatggagatgactttgagattatgtaactgctagcagagcaaagagtgagggcctcatacaaatatttcttaatattgatacatttccctttagcctatagccctagttgagagtgggggttaccccactggccaagttggaaatggcataacagcagagagctgattctgttgcaaaagcgagtgggcatgggaactaatgttaattaagcaccaggtatgttccaagtgcttgactaaatcatcccaaccctgcctgctaagtatgctggtcatctccattttatggggaaatggagactcagagaagtgaagtaacttgtctaaagccactcggccagttaaccatcaaatgtctatcaggcaatgtaccaggcaggcacaggaaagctactgtttgaatctagatctctgtgacactaaagccacactcttccccccaccccccacatacacacactttacaccacctgcttcccaggaagggccgcagacacgtacaggaatcccaattatggggaaagaagatgagcttctgagactattccgatccacaagatttttcaaattcttcacaatctctgtctcatggatcagagagatccatgaatccccaggtcaagatcctactaccctctgaatgatttggacagctgttctctgcaatcagatgggggaaagggcttggggtagctggaacagccttccgctatccctgctgttgacaagaccgtaggatgcagggagaaacaaagaaagagatggcgagagaggggagggaaaaagagaaggaggggagagagagaaactgcttagttttgaattcctttttccagttagccctaaggccagctcccaatccctcctaaggatggattttagcaaagaggaacccctttttattaaagctagttcaaatttggtttctgtaacttgaaaccaatgtgggcacatgggcggggccccagtatcatttactatctagtggtaaccatgtcactgctgatttttatggtgaaatgataaggtggagaagcggttcaccttcagctggtgctgttactgttgttgctgccactgccagcaacatggggcttggtggtggtggtagtgacgtgcgatggtggttgtgagtgtgacgattattggaggggctagcgattatgggtaccaaaattccttggcagagatgctggttattggaggggctaaagatcacaggtaccagcatccctatttcttcaaggtttgtctctttcttttacgctttgtatttctacaatggccctggggagtgaaaagacttagaatttcatcttgtcaagactggtagatgaaaacatgactgaagaattgatgtgcattcattccaccagttaagtcctgttgtgtgtacattttttaacaatgcttgcattccctggggctgcaatttattctacttgccatgatgtcatggttcactgtgaaacacaggagcgtgttgacttcagacttctcaacacattaaacctatgagcagagtgtaacctgccaacgttgtgcccggaagtcgtgaagacttctgggatggattcatcctgcatcaatgagggctagttgttttcagctaaagcttgtgagtatgagggcacagggaccgtgcttgtgagtaagcgggccggcatgctgctgggggtgcgtcaggtagagagactatagcgtgtgcatctgttcctctctctcaatgtctgcccgaatctccttcgccctccccagagtgaagcagtgaggcaggagcaatgctcacatttcactccaagcacctaccttgttatattttcaacaaaatagctttctacctaagaaatattctgggacaaatgtaaagcttattcatccattcaattaatatcggtgatgagccatgcactcgtctaggtgctgggggtataagagtggaaggaaggaacccacaaatccctgctcttatacagctgacattctagcgggtttaaacatgtctcattctcatcacacacaggtgaggaaactgaggttaattgacttaactgaggacaaacagtaaagggcagagctaagattttaagtaagatcagactgatccccaaacccatgcccctgaccaattctatgttatcttcagtgaatattttttaaaaatttgtactgcccaacatcttttcaccattctttgggtactagaaacctccattacttctggtaaaccactcttccagtctccaagatcatctagaaaaactccagtaaaggcatcctgtcctccttcaactgaagaacgggttcataacccaaatatgtcattccaatgctgctttctgctgtcaagacctcctggaagtatgactcttttcgctctcaagttgatttttcagctctgcctatgattctgtaagccatcccatatttttccaatacactttttttatccagttatacagagttcacttctgttgcatataaccaaagaatgaaactaacacattgtcccttcaccctctaggtcttaatttgacccaaagcaggttttgtgatctactaactagaaagtattgcacccacctcccaggaaagaaatcttgtttacttgagccaggcctgccgacatccctggcttctggccccttgttcagacctagccttccaggaaaagcttccctgctctgcaccggggctgccagacttgcagatgctgcacactcagcaaaagcagtggaggagcctgagctatatttgaacttctctgagagcacacagacacagccccctgtgctctggctggcggaggggactggtaattaacagtactcttgttcagagcacaaatggaacaggtgatggatcagcaagttcagaatcagagccacagccaatctctccatccccaagtctatttttgggtcaccacagatgcttattaacaccacatatcagggctacaggacagacaagagacttgtcttggggaacttgtcagtcaaaattacattgagttttatgtaacaagtctgaccagataccgtttttttcccctcacccaacaagaagtccagtggtaggcagtccaggcgggtatagaggctcagagaaatccttaaggattgaagctctttttatcttcctgatctgctatccttagcagctggctctcaccctcatagtcacaagatggctgccccacttccagaagtctcacctacattccaggtaggaataaaagcaaaagcaaagaagagaaggcatgttcctgatgagttttccctacccctttgtatgaggaagacaagagattccaaggaagcctcatccagattttcctgtacatctcattggtcagaactgggtcagaggaccagctgcaagggtatttttaactgggcatattgtcattcaaacaaaactgggattctgttactaagtaagaaagggagtaaaggcattggttaagtaactagtagtgtctgtcacaaaaggtaagatgggaaatgggtcatgatcgagggaggcctccaaggggcttagtcacaggttctcaggagcacacaaactggacccatttccagggtccccatgtggaaaggcagagggctggaggaaggtcttacggctgttcgcagccccgccctcgttctcatggtaacctacagagaaaaccaggagccacatgaatctatcctttatttatttatttagagatggagtctcactctgtcacccaggctggaatgcagtggcacgatctcggctcactgcaacctccgcctcctgggttcaagcgattctcatgcctcagcctcctgagtagctgggattatagacatgtgccaccatgcctggctaatttttgtatttttagtagagacagggtttcattatgttggccaggccggtcttgaactcctgacctcaggtgatctgcccgcttcagcatcccaaattgctggaattacaggcatgagccactgagcctggccaaagctgtcctttaaagatggcattgaggtcagagaaacgtgggaaaggtaaagaggttcaccaaaaaagagtcaaacagctctgatttcaaatccaagctctgccaaataccaatgctctgaccttgggtgaatcacttaacctctctaaaatgggggtaatactttgcacatgttttgtgaggctcaaaaaaacttcaggtatacattgtatatcgtagctatcccaaaaatggtcgttattattacattaattccctccttttctaaatggtgaaaatgaacccagagaggggaagcaagatgacctaagtcacacagccagatagaggcagagctgcgaccgggcccaggctatctgacttccactctgaggggtgttccctatcatcactgcctgtctctgtaacaaaatgatgaacattcattaaagtgtgaaattaggcctgaatggtagaacaaagtcgctgatttagaattttatttaaaaacacaaacctcaaatttcagacactgaagatgccaaaagtcaagcagaaaaggtagaggcatcctggtgtgcccctcctggtgaattctactcattgttactgtcatttactaagtgcaccagccgtgtgcctgacatcacgctaaagcgtctacctaatggcagtagctaacattcatggaacactatgttagtttcctgtggctgctataacaaaatcccacaaacttagtggcttaaaaacacatctttttttttttttttttttttttttttttttttttttttcagagacaggttgtcactctgttgcccaggctagaattcagtggcatgatcatagctcactgcagcctcgaactctcaggctcaagcgagcctcctgccttggcctcctgagtagctggaattacaggcatgcaccaccatatccagctaataaaaaaaatttttttttcagagatagggtgtccatgtttcccaggctggttttgaactcctgagctcaagccatcctcccacctcaacctctaaaactgctgggattacaggagtgagccaccacacccagccaaaaacacaaatttattctcttacagttctggcggtcagaattcctgagatcactgtgtcagcagggctgtgtttagtgagctcgttcccttgcttttttcagattctaaagtcacctgcattccttggcttgtggccccttctttcgtcttcaaagctggcagtgtagcatgttcaaatcaatctctccccaccacacacaaacaccctcgcctctgctttcattgtcatgtctcctcagattctaaccctcctacctccctcttccattttcaattatattgagtccaccaggataatgcccccatctcaaaatccttaattgaatcacacctactagatcctttttgccatgtaaggtaacattcacaggttctggagattgggatgtggacatctttggtagaccactagtttagctaccacaacttttatgcacctggaattgctgtgaattcatataaccctctagacaaacctaggaaatacatactgaggcgggatagataggcaaggaagtaacatgtccgcaggccacaggaaccgtggctgtgaccgtgactgtcaacacagtaagccccagcatttgcattgtagtccagctcatgcaagcaaagctatctccagtagggaatttctcctaggaagagtatgtgcattttgattttacctgtcctcagactgacccttgttcattataatagtaaaaaacacacccctgggtggagatttaagatgctactgagacatgcagtgcatgaacaagcatgtgctacccgcacatgttcacccagaggaccatccaaaacatgcttgctagtaacacctcttcctatccccttaggtaagactcccataaaggaagtttccccgcgcggaatcatccctcagggtggactgtctattctgtacctaactttcagaatattctttctcctttgcaataaattgctctgtgctgcatctcctttgctgtgtgtctcttgtttaacccactgccatttaggaaaaaaaaaaaagtgcagctggctgccagcactcatttaactttacattatcatgctctttgaggctgaagcaaatctgactgattttcaatgtgaaaataaaatataaaatctcttcttggagttatttatttcttttttctttcttttttttcttttcttttctgagacaaggtcttgctctgtcacctgtcaggctggaatgcggtgttgtgatctcagctctctgcaaactctgcctcccgggttcaagtgattctcctgcttcagcttcccgactagctggaattacaggtgcccaccaccacacctggctaattttgtatttttagtagagatggggtttcaccatgttggccagtctggtttcgaaatcctggcctcaagtgatccaccggcctcagcgtcccaaagtgctgggaatacaggcatgagccaccatgcccggagttatttatttctaaacagaacttgtctctaatcctaatgtaacagaaatgtatatgatgatcagtatttaattttttttcatgtggtgaattgcaaagcccagaacaacacaaagcagaacatcacattccacacaaaaatttcacctttctcgtcagatcttcttgccattcctgttgtgtgagcagcagactttgcagccaccaattggactctgtttccctgatgtaggtggtatgctcctggggaagtgtcttccagacaggtgaagaggtgtgacatcatcagagcacagacgacctcaaagacgttaccaccctggcttggggtgcttttccagcattcttccaatcagtgtcagtctgaaatttacatggctaatcgtgtcctcaggattgtccttctctagcaggatgtaggagttccgcactgccatgtttagaaggtggcgaaagagtttcttataccaaaccttgtgccttttgtgctcagttggataagaagagagcatctgatcaactgagtccactgttcccatattctcgttatattccacaatgacacatggcctcttagttttatttccatttctgtggtctacctcaataacagtatcgttgtggaatgttgaaaacattgtcacctccttgtcagaccattttggtgccataaattcaccacagaattaacatcatgcataggaatgctatgttttctaggatttgacattttcagtgattgagaatcactgtattttgtaaatggaaataccactactaaaaagagaatgctgtagaatgatgtctgcccgagagttatctcagggtaaatgctgcagctgcacaagtattttcagggcaaacgggaaatgggttaaatcattttattttattattaatattttttgagatggagtctcgctctgtcatccaggctggagtgcagtggtgcgatcttggctcactgcaacctctgtctcctgggttcaagcagttctcctgcctcagcctcccaagtagctgggatttcaggccaccatgcccagctgtttttgtatttttagtagagacagggtttcactgtgttggccaggctgatctcaaactcctgacctcaagtgatccacctgcctcggcctcccgtgtgagccactgcacccggctggttaaattattttaaactaagaagataagaactgaggtttcacaacagctatcaccaatactatcattttgcccattttcaattgacaagccatgttagtttcctattgctgctacaacaaattgccacaaacttagtggcttaaacaatgcaaatgtgtcatcttacagttctgctggttacaagtctacatgggcaccttgggctgcgttccttcccgggactacctgcattccttggctagtgaccttgttcatctacccagcaacaatgatcaagtctttcttatcactccaactgttcttctgtagtcgcatcttcttccctctgaatgtcctctcctgcctccctcttccacttttaaagaccttcgtgattacattgggtccacccagagagtaacacagaatactctccctgccttaaagtcaggcaattaggagggttttgtttttgtttttgttttttgagacagggtttggctctgtcatccagggtggggtacaatggcgtgatcttggctcactgcaacctccatccgcctgtaggactcaagcaagccttctacctcagcctcccaagtagctgggactacaagtgggcaccactttttttttttttttttttggtagagatgggctttcaccatgtttcccaggctggtctggaactcctgggctcaagcgatcctcctgccttaacctcccaaggcactgggattacaggagtgagccaccacgcccggcagattagcagtcttaattccatctgcagcctcaattccctttgccatgtaacctaacatattcataggtttggttttaggacatgggcatttttgggaggccatgattgtgcctaccacacaagccaaagacccagagaggctaaataatttgccacaggttatatggctagaaaacggtagagccagacttcaaaagcaggctgaccccagcactttgaatgagtgctgacccaagcactctcattgttaatcattgcactacacttccgtagctcgttttcccttctcagcaaccctactgtgaggtaggtatggttatgactgctatgtgcagtttacagttgaagacatgaagactctcagggatgatgtggcttgcccaaagttcacacaggtagtggaaagcagaggaaccaggttagtcggactcagataagagatgtacccaaagccaggcacggtggctcacacctgtaatcccagcactgtgggaggctaagatgggaggatcacttgaactctagagcttgagaccagcctgggcaacataggtagacctgtctccacagaaaactttaaaaaatagccaggcgtggtgatgtgcgcttgtagtcccagctactcaggaggctggggtgggaggattacttgagcctgggaggtcaagcctgcagtgaactataattgcagcactgcactccagcctgggtaactgagcaagaccttgtctcaaaaaacaaaaaaacaacaaaaacaaaaacaaaaaaaacaaaaacagagagagagagagagagagacagaggtacccacaatgaaaggaagacattggctactgtgagagtgagattgtcatccttaaaccaagagcatttcagctgggcgcagtggctcacgcctataatctcagcaatttgggaggccaaggtgggtgggtcacctgaggtggggaatttgaggccagcttgaccaacatggagaaacgccatatctaataaaaatacaaaattagccaggcatgatggcaggtgtctgtaatcccagctactcgggaggctgaggcaggagaatcgcttgaacccaggaggcagatgttgcggtgagccaagatcacgctattgcaccccagcctggcaaaagagcgagactccatctcaaaaaacacacacacaaacaaaaaacaaaccacaagagcatttcaaatacttttgctaaaatcaacagctcttcccttaggtatcccacagtactggactactctcatttccttcagacctcttctcaaatgtcagctactcagcgataccctgaccaccctatccaaaatagtagctctcatgccccaacccccattctcttgtctcttctcttactgcttgtcataattatgtaaattttttgtgctagaacaaatgcttcatgagagcaggggctgtgtctgttttgtacactgctgcattcccagggtctggcatccagcaggcactccataattttttagtctgaaatcaataataacttaatccaatctcaatattctcatcaatggacttgagaataagcaaatgttattaatgtatctacattagatactgggactcttggcatttcaattgaaaaaggctttcggagatatgaaggactggaccagcaagagattctccaagtttctagccttggctggtcatgaaacttttaagggaaggccaggcacagtggctcaggcctgtaaccccaggactttgggaggccaaggcaggcagatggcttgaactcaggcgttcaagaccagcctgggcaacatggtgaaaccccatctccacaaaaaaatacaaaaaattagccaggtatggtggtgcacgcctgtagtcctagctactcaagaggctgaggtgggaagatggctagagcccaggaagcagaggctgcagtgtgagtcaagatcatgccactgcaccccagcctgggtgacagagccagactgtgtctcagaaaaaaaaaaaaaattgtaagggaagcttgattaaaacaccaatacccagtgcctaccctcaaagattctcattgaattggtctgaagagtgttctgaacatcagcattttttaaggctctccaggtgatgctaatgtgcctctgtggttgccattcacagccctggacctcctaaactagaatccctgggacaaaggttttcaaccttgacagagctttggaaaatactgatgttggagtaccacctccaaagattttgatgtaattaggctggatgaggcccagggaatagatttttcattttcgttattatacttctcagctccagaatgtctatgtagcgccatacattgttttcctgatttccttgagttttttattcaagatttcctttagttctttcagcatattgaacgtagctgatttaaagtctttggctagtaaatccaatgtctgggctttctcagggacaatttatgtccatttattttgctcctttttttttttttttttttgatacagagtctcgctctgttgcccaggctggagtgcagtggtgcaatcttggctcactgcaagctccgcctcctgggttcacgccattctcctgcctcagcctcctgagtagctgggactacaggcacccgccaccgtgcccggctaattttgttgttgttgttgttgtatttttagtagagacagggtttcaccgcgttagccaggatggtctcgatctcctgacctcgtgattcgcccgcctcggcctcccaaagtgctgggattacaggtgtgagccaccatgcctggcctattttgctccttttttaactgaaaaattaaagttaactttacacttgatgggtgccaaaagtcttgcacccagatcagctgcagacaagaacagaaattttaaacaaatgagatcaaaatcctgaagcattctccacagaactgtaacagggatgaaacatttactagtataatcctgaagacaaagcacaatcaaagcaatggctaccaagagatggaagtggttcagtcaatgcaaaagcaggctggtcaagagcaaagatcatggc

SEQ ID NO: 4 - DNA, 321 bp, Homo Sapiens
aggagtttggaaacacactgtttgtaaagtctgcaattggatatatggacctgtttgaggccttcgttggaaacgggatttcttcattgaatgctagacggaagaattctcagtaaattctttgtgttgtgtgcattcaactcacagagtggaacgtccctttagacagagcagatttgaaacactctttttgcggaatttccaagtggagatttctagccatttgatgccaacagtagaaagggaaatatcttcaaataaaaaccagacagaatcattctcagaaaattctttgtgatgtgtgcgttcaactcacatagt

The invention claimed is:

1. A probe set for detecting biomarkers in a sample indicative of HPV-associated precancer and cancer, said probe set consisting of a probe that hybridizes to 3q26, a probe that hybridizes to 5p15, a probe that hybridizes to 20q13, and a probe that hybridizes to cen7, wherein:

(a) the probe that hybridizes to 3q26 comprises a probe preparation of seven different nick-translated clones corresponding to chromosome 3, clones 1-7 of Table 4;

(b) the probe that hybridizes to 5p15 comprises a probe preparation of five different nick-translated clones corresponding to chromosome 5, clones 1-5 of Table 4;

(c) the probe that hybridizes to 20q13 comprises a probe preparation of three different nick-translated clones corresponding to chromosome 20, clones 1-3 of Table 4; and (d) the probe that hybridizes to cen7 comprises a probe preparation of a nick-translated clone corresponding to chromosome 7, clone 1 of Table 4.

2. The probe set of claim 1, wherein the HPV-associated precancer or cancer occurs in at least one human tissue selected from the group consisting of the cervix, the anus, the vulva, the vagina, the penis, oropharynx, and pharynx.

3. The probe set of claim 1, wherein said probe that hybridizes to 3q26 is capable of hybridizing to SEQ ID NO: 1 or complement thereof.

4. The probe set of claim 1, wherein said probe that hybridizes to 5p15 is capable of hybridizing to SEQ ID NO: 2 or complement thereof.

5. The probe set of claim 1, wherein said probe that hybridizes to 20q13 is capable of hybridizing to SEQ ID NO: 3 or complement thereof.

6. The probe set of claim 1, wherein said probe that hybridizes to cen7 is capable of hybridizing to SEQ ID NO: 4 or complement thereof.

7. The probe set of claim 1, wherein each of the probes comprises a label capable of emitting a signal.

8. The probe set of claim 7, wherein the signal is detectable by a human observer.

9. The probe set of claim 7, wherein the signal is detectable by an analytical instrument.

10. The probe set of claim 7, wherein the label comprises a moiety selected from the group consisting of fluorescent moieties, radioactive moieties, chromogenic moieties, and enzymatic moieties.

11. The probe set of claim 1, wherein each of the probes is labeled with a different color fluorochrome.

* * * * *